US011434488B2

(12) United States Patent
Freier

(10) Patent No.: US 11,434,488 B2
(45) Date of Patent: Sep. 6, 2022

(54) COMPOUNDS AND METHODS FOR REDUCING ATXN3 EXPRESSION

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Carlsbad, CA (US)

(*) Notice: Subject to any disclaimer, the term of this patent is extended or adjusted under 35 U.S.C. 154(b) by 44 days.

(21) Appl. No.: 17/053,997

(22) PCT Filed: May 9, 2019

(86) PCT No.: PCT/US2019/031562
§ 371 (c)(1),
(2) Date: Nov. 9, 2020

(87) PCT Pub. No.: WO2019/217708
PCT Pub. Date: Nov. 14, 2019

(65) Prior Publication Data
US 2022/0064637 A1    Mar. 3, 2022

Related U.S. Application Data

(60) Provisional application No. 62/669,238, filed on May 9, 2018.

(51) Int. Cl.
C12N 15/113 (2010.01)
C12Q 1/68 (2018.01)

(52) U.S. Cl.
CPC ...... *C12N 15/113* (2013.01); *C12N 2310/315* (2013.01); *C12N 2310/322* (2013.01); *C12N 2310/3341* (2013.01); *C12N 2310/346* (2013.01); *C12N 2320/30* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |

(Continued)

FOREIGN PATENT DOCUMENTS

| | | |
|---|---|---|
| JP | 2011125219 | 6/2011 |
| WO | WO 2002/058626 | 8/2002 |

(Continued)

OTHER PUBLICATIONS

Fiszer et al., "Oligonucleotide-based strategies to combat polyglutamine diseases" Nucleic Acids Res (2014) 42: 6787-6810.
Extended EP Search report for 19799466.8 dated Jan. 14, 2022.
Alves et al., "Allele-Specific RNA Silencing of Mutant Ataxin-3 Mediates Neuroprotection in a Rat Model of Machado-Joseph Disease" PLoS ONE (2008) 3(10):e3341.
Alves et al., "Silencing ataxin-3 mitigates degeneration in a rat model of Machado-Joseph disease: no role for wild-type ataxin-3?" Hum. Mol. Gen. (2010) 19(12): 2380-2394.
Branch et al., "A good antisense molecule is hard to find," TIBS (1998) 23:45-50,.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

(Continued)

*Primary Examiner* — Sean McGarry
(74) *Attorney, Agent, or Firm* — McNeill Baur PLLC

(57) ABSTRACT

Provided are compounds, methods, and pharmaceutical compositions for reducing the amount or activity of ATXN3 RNA in a cell or animal, and in certain embodiments reducing the amount of ATXN3 protein in a cell or animal. Such compounds, methods, and pharmaceutical compositions are useful to ameliorate at least one symptom or hallmark of a neurodegenerative disease. Such symptoms and hallmarks include motor dysfunction, aggregation formation, and neuron death. Such neurodegenerative diseases include spinocerebellar ataxia type 3(SCA3).

50 Claims, No Drawings

Specification includes a Sequence Listing.

(56) References Cited

U.S. PATENT DOCUMENTS

| | | |
|---|---|---|
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,840,491 A | 11/1998 | Kakizuka |
| 5,859,221 A | 1/1999 | Cook et al. |
| 5,945,290 A | 8/1999 | Cowsert et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,255,051 B1 | 7/2001 | Hammond et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,250,289 B2 | 7/2007 | Zhou |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,834,170 B2 | 11/2010 | Khvorova et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,178,503 B2 | 5/2012 | Rigoutsos et al. |
| 8,263,760 B2 | 9/2012 | De Kimpe et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,329,890 B2 | 12/2012 | Davidson et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,779,116 B2 | 7/2014 | Davidson et al. |
| 8,828,956 B2 | 9/2014 | Manoharan et al. |
| 8,901,095 B2 | 12/2014 | Corey et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,340,785 B2 | 5/2016 | Corey et al. |
| 9,487,779 B2 | 11/2016 | Davidson et al. |
| 9,574,191 B2 | 2/2017 | Corey et al. |
| 9,976,138 B2 | 5/2018 | Prakash et al. |
| 10,041,074 B2 | 8/2018 | Ozsolak |
| 10,364,432 B2 | 7/2019 | Van Roon-Mom et al. |
| 10,533,175 B2 | 1/2020 | Rigo et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |

(56) References Cited

U.S. PATENT DOCUMENTS

| | | |
|---|---|---|
| 2004/0171570 A1 | 9/2004 | Allerson et al. |
| 2005/0130923 A1 | 6/2005 | Bhat et al. |
| 2005/0244851 A1 | 11/2005 | Blume et al. |
| 2005/0272080 A1 | 12/2005 | Palma et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |
| 2011/0190222 A1 | 8/2011 | Corey et al. |
| 2013/0130378 A1 | 5/2013 | Manoharan et al. |
| 2013/0198877 A1 | 8/2013 | Van Roon-Mom et al. |
| 2013/0225659 A1 | 8/2013 | Bennett |
| 2014/0039037 A1 | 2/2014 | Van Roon-Mom et al. |
| 2014/0107330 A1 | 4/2014 | Freier et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0211006 A1 | 7/2015 | Butler et al. |
| 2015/0267195 A1 | 9/2015 | Seth et al. |
| 2015/0267197 A1 | 9/2015 | Bennett et al. |
| 2015/0275212 A1 | 10/2015 | Albaek et al. |
| 2015/0315595 A1 | 11/2015 | Uzcategui et al. |
| 2016/0159846 A1 | 6/2016 | Prakash et al. |
| 2018/0258425 A1 | 9/2018 | Rigo et al. |
| 2019/0247420 A1 | 8/2019 | Freier et al. |

FOREIGN PATENT DOCUMENTS

| | | |
|---|---|---|
| WO | WO 2004/013280 | 2/2004 |
| WO | WO 2004/045543 | 6/2004 |
| WO | WO 2004/058940 | 7/2004 |
| WO | WO 2006/006948 | 1/2006 |
| WO | WO 2010/014592 | 2/2010 |
| WO | WO 2011/097388 | 8/2011 |
| WO | WO 2011/097643 | 8/2011 |
| WO | WO 2012/012467 | 1/2012 |
| WO | WO 2012/018257 | 2/2012 |
| WO | WO 2013/033223 | 5/2013 |
| WO | WO 2013/138353 | 9/2013 |
| WO | WO 2013/173635 | 11/2013 |
| WO | WO 2013/173637 | 11/2013 |
| WO | WO 2015/017675 | 2/2015 |
| WO | WO 2015/053624 | 4/2015 |
| WO | WO 2015/143246 | 9/2015 |
| WO | WO 2017/053781 | 3/2017 |
| WO | WO 2018/002886 | 1/2018 |
| WO | WO 2018/089805 | 5/2018 |
| WO | WO 2019/217708 | 11/2019 |
| WO | WO 2020/172559 | 8/2020 |
| WO | WO 2020/245233 | 12/2020 |

OTHER PUBLICATIONS

Costa et al., "Toward RNAi therapy for the polyglutamine disease Machado-Joseph disease" Mol Ther (2013) 21: 1898-1908.
Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Evers et al., "Ataxin-3 Protein and RNA Toxicity in Spinocerebellar Ataxia Type 3: Current Insights and Emerging Therapeutic Strategies." Mol Neurobiol (2014) 49:1513-1531.
Evers et al., "Ataxin-3 protein modification as a treatment strategy for spinocerebellar ataxia type 3: Removal of the CAG containing exon" Neurobiloby of Disease (2013) 58: 49-56.
Gautschi et al., "Activity of a novel bcl-2/bcl-xLbispecific antisense oligonucleotide against tumors of diverse histologic origins" J. Natl. Cancer Inst. (2001) 93:463-471.

GenBank Accession No. NM_004993.5.
Hu et al., "Allele-specific silencing of mutant huntingtin and ataxin-3 genes by targeting expanded CAG repeats inmRNAs." Nat. Biotech. (2009) 27(5): 478-484.
Hu et al., "Allele-selective inhibition of huntingtin expression by switching to an miRNA-like RNAi mechanism" Chem Biol (2010) 17(11): 1183-1188.
Hu et al., Allele-selective inhibition of ataxin-3 (ATX3) expression by antisense oligomers and duplex RNAs. Biol. Chem. (2011) 392(4): 315-325.
Kawaguchi et al., "CAG expansions in a novel gene for Machado-Joseph disease at chromosome 14q32.1." Nat. Genet. (1994) 8(3): 221-228.
Kenski et al., "siRNA-optimized Modifications for Enhanced In Vivo Activity" Mol Ther Nucleic Acids (2012) 1-8.
Liu et al., "ss-siRNAs allele selectively inhibit ataxin-3 expression: multiple mechanisms for an alternative gene silencing strategy." Nucleic Acids Res. (2013) 41(20): 9570-9583.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
McLoughlin et al., "Oligonucleotide therapy mitigates disease in Spinocerebellar Ataxia Type 3 mice." Annals of Neurology (2018) Accepted Article online Jun. 16, 2018, pp. 1-25.
Miller et al., "Allele-specific silencing of dominant disease genes." PNAS (2003) 100(12): 7195-7200.
Moore et al, "Evaluation of Antisense Oligonucleotides Targeting ATXN3 in SCA3 Mouse Models" Molecual Therapy:Nucliec Acids (2017) 7:200-210.
Moore et al, "Widespread In vivo suppression of mutant ATXN3 by anti sense oligonucleotides in transgenic mouse models of SCA3" Society for Neuroscience 2016 Neuroscience meeting, San Diego, CA, Retreievd from the internet on Aug. 2, 2018, http://www.abstractsonline.com/pp8/#!/4071/presentation/6726.
Moore et al, "Widespread In vivo suppression of mutant ATXN3 by anti sense oligonucleotides in transgenic mouse models of SCA3" Society for Neuroscience 2016 Neuroscience meeting, San Diego, CA, Poster Presentation Nov. 12, 2016.
New England Biolabs 1998/99 Catalog (cover page and pp. 121 and 284).
Reynolds et al., "Rational siRNA design for RNA interference" Nature Biotechnology (2004) 22(3):326-330.
Riess, et al., "SCA:3 Neurological features, patholgenesis and animal models." The Cerebellum (2008) 7:125-137.
Rodriguez-Lebron et al., "Silencing mutant ATXN3 expression resolves molecular phenotypes in SCA3 transgenic mice." Mol. Ther. (2013) 21(10): 1909-1918.
Sanghvi et al., "Heterocyclic Base Modifications in Nucleic Acids and Their Applications in Antisense Oligonucleotides" Antisense Research and Applications (1993) pp. 273-288.
Seidel et al., "Axonal inclusions in spinocerebellar ataxia type 3," Acta Neuropathol (2010) 120:449-460.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Toonen et al., "Antisense Oligonucleotide-Mediated Removal of the Polyglutamine Repeat in Spinocerebellar Ataxia Type 3 Mice" Mol Ther Nucleic Acids (2017) 8:232-242.
Toonen et al., "Ataxin-3 exon skipping as a treatment strategy for Spinocerebellar Ataxia type 3" Oligonucleotide Therapeutics Society 2015 Annual Meeting, Leiden, The Netherlands, Poster Presentaiton, Oct. 11, 2015.
Ward et al., "Ataxin-3, DAN damage repair, and SCA3 cerebellar degeneration: on the path to parsimony?" PLoS Genet (2015) 11(1):e1004937(1-4).
Woolf et al., "Specificity of antisense oligonucleotides in vivo" PNAS (1992) 89: 7305-7309.
Yu et al., "Single-stranded RNAs use RNAi to potently and allele-selectively inhibit mutant huntingtin expression" Cell (2012) 150(5): 895-908.
Partial Search Report for 16849742.8 dated Mar. 14, 2019.

(56) References Cited

OTHER PUBLICATIONS

Partial Search Report for 17869883.3 dated Apr. 24, 2020.
Extended EP Search report for 17869883.3 dated Jul. 16, 2020.
International Search Report for PCT/US17/61121 dated Apr. 26, 2018.
International Search Report for PCT/US19/031562 dated Sep. 17, 2019.
International Search Report for PCT/US20/019272 dated Jul. 1, 2020.

COMPOUNDS AND METHODS FOR REDUCING ATXN3 EXPRESSION

SEQUENCE LISTING

The present application is being filed along with a Sequence Listing in electronic format. The Sequence Listing is provided as a file entitled BIOL0331USASEQ_ST25.txt, created on Nov. 3, 2020 Apr. 24, 2019, which is 680 KB in size. The information in the electronic format of the sequence listing is incorporated herein by reference in its entirety.

FIELD

Provided are compounds, methods, and pharmaceutical compositions for reducing the amount or activity of ATXN3 RNA in a cell or animal, and in certain instances reducing the amount of Ataxin-3 protein in a cell or animal. Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include spinocerebellar ataxia type 3(SCA3).

BACKGROUND

Spinocerebellar ataxia type 3 (SCA3), also known as Machado-Joseph disease (MJD), is caused by a mutation in the ATXN3 gene and is characterized by progressive cerebellar ataxia and variable findings including a dystonic-rigid syndrome, a parkinsonian syndrome, or a combined syndrome of dystonia and peripheral neuropathy. SCA3 is inherited in an autosomal dominant manner. Offspring of affected individuals have a 50% chance of inheriting the mutation. The diagnosis of SCA3 rests on the use of molecular genetic testing to detect an abnormal CAG trinucleotide repeat expansion in ATXN3. Affected individuals have alleles with 52 to 86 CAG trinucleotide repeats. Such testing detects 100% of affected individuals. Expanded CAG repeats in the ATXN3 gene are translated into expanded polyglutamine repeats (polyQ) in the ataxin-3 protein and this toxic ataxin-3 protein is associated with aggregates. The polyglutamine expanded ataxin-3 protein in these aggregates is ubiquinated and the aggregates contain other proteins, including heat shock proteins and transcription factors. Aggregates are frequently observed in the brain tissue of SCA3 patients. Management of SCA3 is supportive as no medication slows the course of disease; restless legs syndrome and extrapyramidal syndromes resembling parkinsonism may respond to levodopa or dopamine agonists; spasticity, drooling, and sleep problems respond variably to lioresal, atropine-like drugs, and hypnotic agents; botulinum toxin has been used for dystonia and spasticity; daytime fatigue may respond to psychostimulants such as modafinil; accompanying depression should be treated. Riess, O., Rüb, U., Pastore, A. et al. Cerebellum (2008) 7: 125.

Currently there is a lack of acceptable options for treating neurodegenerative diseases such as SCA3. It is therefore an object herein to provide compounds, methods, and pharmaceutical compositions for the treatment of such diseases.

SUMMARY OF THE INVENTION

Provided herein are compounds, methods, and pharmaceutical compositions for reducing the amount or activity of ATXN3 RNA, and in certain embodiments reducing the amount of Ataxin-3 protein in a cell or animal. In certain embodiments, the animal has a neurodegenerative disease. In certain embodiments, the animal has SCA3. In certain embodiments, compounds useful for reducing expression of ATXN3 RNA are oligomeric compounds. In certain embodiments, the oligomeric compound comprises a modified oligonucleotide.

Also provided are methods useful for ameliorating at least one symptom or hallmark of a neurodegenerative disease. In certain embodiments, the neurodegenerative disease is SCA3. In certain embodiments symptoms and hallmarks include ataxia, neuropathy, and aggregate formation. In certain embodiments, amelioration of these symptoms results in improved motor function, reduced neuropathy, and reduction in number of aggregates.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

As used herein, "2'-deoxynucleoside" means a nucleoside comprising a 2'-H(H) deoxyribosyl sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5-position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is ataxia, neuropathy, and aggregate formation. In certain embodiments, amelioration of these symptoms results in improved motor function, reduced neuropathy, or reduction in number of aggregates.

As used herein, "bicyclic nucleoside" or "BNA" means a nucleoside comprising a bicyclic sugar moiety. As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "chirally controlled" in reference to an internucleoside linkage means chirality at that linkage is enriched for a particular stereochemical configuration.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-OCH$_2$CH$_2$OCH$_3$ group in place of the 2'—OH group of a ribosyl sugar moiety.

As used herein, "2'-MOE nucleoside" means a nucleoside comprising a 2'-MOE modified sugar.

As used herein, "motif" means the pattern of unmodified and/or modified sugar moieties, nucleobases, and/or internucleoside linkages, in an oligonucleotide.

As used herein, "motif" means the pattern of unmodified and/or modified sugar moieties, nucleobases, and/or internucleoside linkages, in an oligonucleotide.

As used herein, "neurodegenerative disease" means a condition marked by progressive loss of structure or function of neurons, including death of neurons. In certain embodiments, neurodegenerative disease is spinocerebellar ataxia type 3 (SCA3).

As used herein, "nucleobase" means an unmodified nucleobase or a modified nucleobase. As used herein an "unmodified nucleobase" is adenine (A), thymine (T), cytosine (C), uracil (U), and guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution, or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "phosphorus moiety" means a group of atoms comprising a phosphorus atom. In certain embodiments, a phosphorus moiety comprises a mono-, di-, or tri-phosphate, or phosphorothioate.

As used herein "prodrug" means a therapeutic agent in a form outside the body that is converted to a different form within an animal or cells thereof. Typically, conversion of a prodrug within the animal is facilitated by the action of an enzyme (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 1 and reasonable variations thereof.

As used herein, "standard in vivo assay' means the experiment described in Example 4 and reasonable variations thereof.

As used herein, "stereorandom" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

CERTAIN EMBODIMENTS

The present disclosure provides the following non-limiting numbered embodiments:

Embodiment 1. An oligomeric compound, comprising a modified oligonucleotide consisting of 12 to 50 linked nucleosides wherein the nucleobase sequence of the modified oligonucleotide is at least 90% complementary to an equal length portion of an ATXN3 nucleic acid, and wherein the modified oligonucleotide comprises at least one modification selected from a modified sugar, a sugar surrogate, and a modified internucleoside linkage.

Embodiment 2. An oligomeric compound, comprising a modified oligonucleotide consisting of 12 to 50 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases of any of the nucleobase sequences of SEQ ID NOs: 15-2787.

Embodiment 3. An oligomeric compound comprising a modified oligonucleotide consisting of 12 to 50 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:

an equal length portion of nucleobases 138-175 of SEQ ID NO: 1;
an equal length portion of nucleobases 392-436 of SEQ ID NO: 1;
an equal length portion of nucleobases 1120-1146 of SEQ ID NO: 1;
an equal length portion of nucleobases 1823-1882 of SEQ ID NO: 1;
an equal length portion of nucleobases 3042-3098 of SEQ ID NO: 1;
an equal length portion of nucleobases 3749-3801 of SEQ ID NO: 1;
an equal length portion of nucleobases 5997-6021 of SEQ ID NO: 1;
an equal length portion of nucleobases 19437-19476 of SEQ ID NO: 2;
an equal length portion of nucleobases 34440-34486 of SEQ ID NO: 2;
an equal length portion of nucleobases 39883-39904 of SEQ ID NO: 2; or an equal length portion of nucleobases 6597-6618 of SEQ ID NO: 2.

Embodiment 4. The oligomeric compound of any one of embodiments 1-3, wherein the ATXN3 nucleic acid has the nucleobase sequence of any of SEQ ID NOs: 1, 2, 3, 4, or 5.

Embodiment 5. The oligomeric compound of any one of embodiments 1-4, consisting of a single-stranded modified oligonucleotide.

Embodiment 6. The oligomeric compound of any one of embodiments 1-5, wherein at least one internucleoside linkage of the modified oligonucleotide is a modified internucleoside linkage.

Embodiment 7. The oligomeric compound of embodiment 6, wherein the modified internucleoside linkage is a phosphorothioate internucleoside linkage.

Embodiment 8. The oligomeric compound of any one of embodiments 1-5, wherein each internucleoside linkage of the modified oligonucleotide is a modified internucleoside linkage.

Embodiment 9. The oligomeric compound of embodiment 8, wherein each modified internucleoside linkage of the modified oligonucleotide is a phosphorothioate internucleoside linkage.

Embodiment 10. The oligomeric compound of any one of embodiments 1-7, wherein at least one internucleoside linkage of the modified oligonucleotide is a phosphodiester internucleoside linkage.

Embodiment 11. The oligomeric compound of any one of embodiments 1-7 and 10, wherein each internucleoside linkage of the modified oligonucleotide is either a phosphodiester internucleoside linkage or a phosphorothioate internucleoside linkage.

Embodiment 12. The oligomeric compound of any one of embodiments 1-11, wherein at least one nucleobase of the modified oligonucleotide comprises a modified nucleobase.

Embodiment 13. The oligomeric compound of embodiment 12, wherein the modified nucleobase is a 5-methyl cytosine.

Embodiment 14. The oligomeric compound of any one of embodiments 1-13, wherein the modified oligonucleotide comprises at least one modified nucleoside comprising a modified sugar moiety.

Embodiment 15. The oligomeric compound of embodiment 14, wherein the modified oligonucleotide comprises at least one modified nucleoside comprising a bicyclic sugar moiety.

Embodiment 16. The oligomeric compound of embodiment 15, wherein the modified oligonucleotide comprises at least one modified nucleoside comprising a bicyclic sugar moiety having a 2'-4' bridge, wherein the 2'-4' bridge is selected from —O—CH2-; and —O—CH(CH3)-.

Embodiment 17. The oligomeric compound of any of embodiments 1-13, wherein the modified oligonucleotide comprises at least one modified nucleoside comprising a non-bicyclic sugar moiety.

Embodiment 18. The oligomeric compound of embodiment 17, wherein the modified oligonucleotide comprises at least one modified nucleoside comprising a modified non-bicyclic sugar moiety comprising a 2'-MOE or 2'-OMe.

Embodiment 19. The oligomeric compound of embodiment 18, wherein each modified nucleoside of the modified oligonucleotide comprises a modified non-bicyclic sugar moiety comprising a 2'-MOE or 2'-OMe.

Embodiment 20. The oligomeric compound of any of embodiments 1-13, wherein the modified oligonucleotide comprises at least one modified nucleoside comprising a sugar surrogate.

Embodiment 21. The oligomeric compound of embodiment 20, wherein the modified oligonucleotide comprises at least one modified nucleoside comprising a sugar surrogate selected from morpholino and PNA.

Embodiment 22. The oligomeric compound of any of embodiments 1-18 and 20-21, wherein the modified oligonucleotide is a gapmer.

Embodiment 23. The oligomeric compound of any of embodiments 1-18 and 20-21, wherein the modified oligonucleotide has a sugar motif comprising:
 a 5'-region consisting of 1-6 linked 5'-nucleosides;
 a central region consisting of 6-10 linked central region nucleosides; and
 a 3'-region consisting of 1-6 linked 5'-nucleosides;
wherein each of the 5'-region nucleosides and each of the 3'-region nucleosides comprises a modified sugar moiety and each of the central region nucleosides comprises a 2'-deoxyribosyl sugar moiety.

Embodiment 24. The oligomeric compound of embodiments 1-7 or 10-23, wherein the modified oligonucleotide consists of 20 linked nucleosides and has the following internucleoside motif: sooossssssssssssooss; wherein,
 s=a phosphorothioate internucleoside linkage, and
 o=a phosphodiester internucleoside linkage.

Embodiment 25. The oligomeric compound of any one of embodiments 1-23, wherein the modified oligonucleotide consists of 12-22, 12-20, 14-20, 16-20, 18-20, or 18-22 linked nucleosides.

Embodiment 26. The oligomeric compound of any one of embodiments 1-23 and 25, wherein the modified oligonucleotide consists of 16, 17, 18, 19, or 20 linked nucleosides.

Embodiment 27. The oligomeric compound of any of embodiments 1-26 consisting of the modified oligonucleotide.

Embodiment 28. The oligomeric compound of any of embodiments 1-26 comprising a conjugate group comprising a conjugate moiety and a conjugate linker.

Embodiment 29. The oligomeric compound of embodiment 28, wherein the conjugate group comprises a GalNAc cluster comprising 1-3 GalNAc ligands.

Embodiment 30. The oligomeric compound of embodiment 28 or 29, wherein the conjugate linker consists of a single bond.

Embodiment 31. The oligomeric compound of embodiment 28, wherein the conjugate linker is cleavable.

Embodiment 32. The oligomeric compound of embodiment 28, wherein the conjugate linker comprises 1-3 linker-nucleosides.

Embodiment 33. The oligomeric compound of any of embodiments 28-32, wherein the conjugate group is attached to the modified oligonucleotide at the 5'-end of the modified oligonucleotide.

Embodiment 34. The oligomeric compound of any of embodiments 28-32, wherein the conjugate group is attached to the modified oligonucleotide at the 3'-end of the modified oligonucleotide.

Embodiment 35. The oligomeric compound of any of embodiments 1-26 or 28-34 comprising a terminal group.

Embodiment 36. The oligomeric compound of any of embodiments 1-35 wherein the oligomeric compound is a singled-stranded oligomeric compound.

Embodiment 37. The oligomeric compound of any of embodiments 1-31 or 33-34, wherein the oligomeric compound does not comprise linker-nucleosides.

Embodiment 38. An oligomeric duplex comprising an oligomeric compound of any of embodiments 1-35 and 37.

Embodiment 39. An antisense compound comprising or consisting of an oligomeric compound of any of embodiments 1-37 or an oligomeric duplex of embodiment 38.

Embodiment 40. A modified oligonucleotide consisting of 12 to 50 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases of any of the nucleobase sequences of SEQ ID NOs: 15-2787.

Embodiment 41. A pharmaceutical composition comprising an oligomeric compound of any of embodiments 1-37, an oligomeric duplex of embodiment 38, an antisense compound of embodiment 39, or a modified oligonucleotide of embodiment 40 and at least one of a pharmaceutically acceptable carrier or diluent.

Embodiment 42. The pharmaceutical composition of embodiment 41, wherein the modified oligonucleotide is a sodium salt.
Embodiment 43. A method comprising administering to an animal the pharmaceutical composition of any of embodiments 41-42.
Embodiment 44. The method of embodiment 43, wherein the animal is a human Embodiment 45. A method of treating a disease associated with ATXN3 comprising administering to an individual having or at risk for developing a disease associated with ATXN3 a therapeutically effective amount of a pharmaceutical composition of embodiments 41 and 42, and thereby treating the disease associated with ATXN3.

Embodiment 46. The method of embodiment 45, wherein the disease associated with ATXN3 is a neurodegenerative disease.
Embodiment 47. The method of embodiment 46, wherein the neurodegenerative disease is SCA3.
Embodiment 48. The method of embodiment 47, wherein at least one symptom or hallmark of the neurodegenerative disease is ameliorated.
Embodiment 49. The method of embodiment 48, wherein the symptom or hallmark is ataxia, neuropathy, and aggregate formation.
Embodiment 50. A modified oligonucleotide according to the following chemical structure:

(SEQ ID NO: 423)

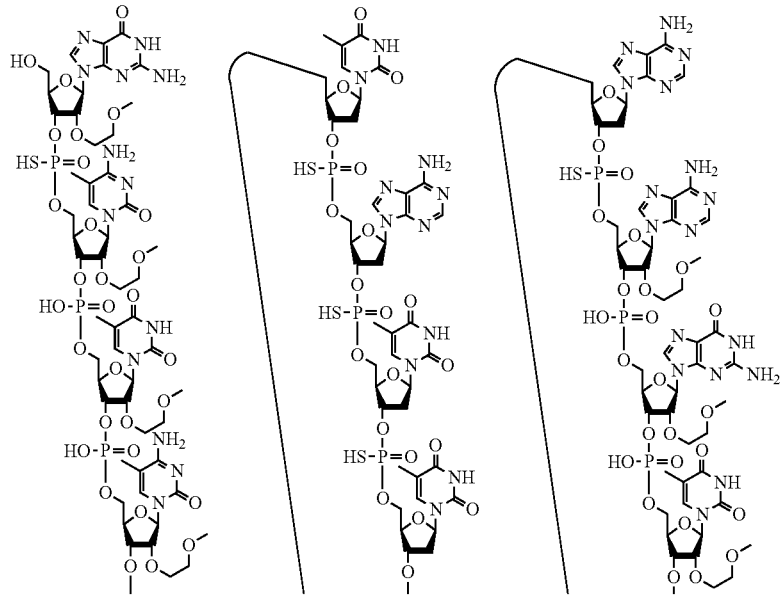

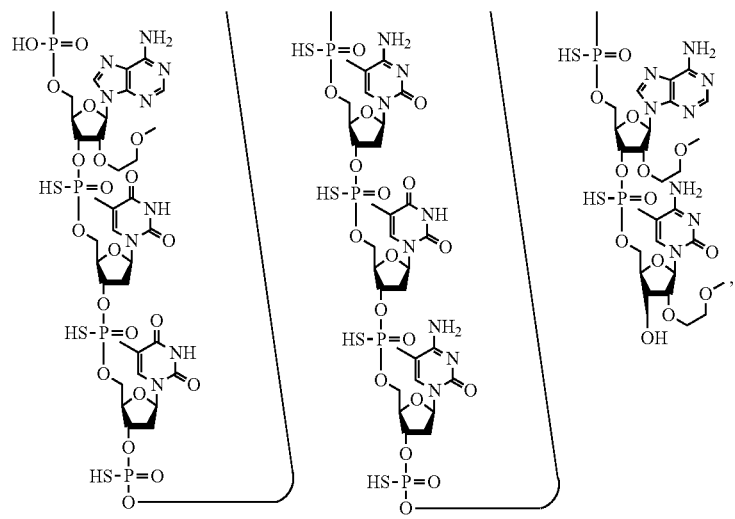

or a salt thereof.

Embodiment 51. A modified oligonucleotide according to the following chemical structure:
(SEQ ID NO: 1226)
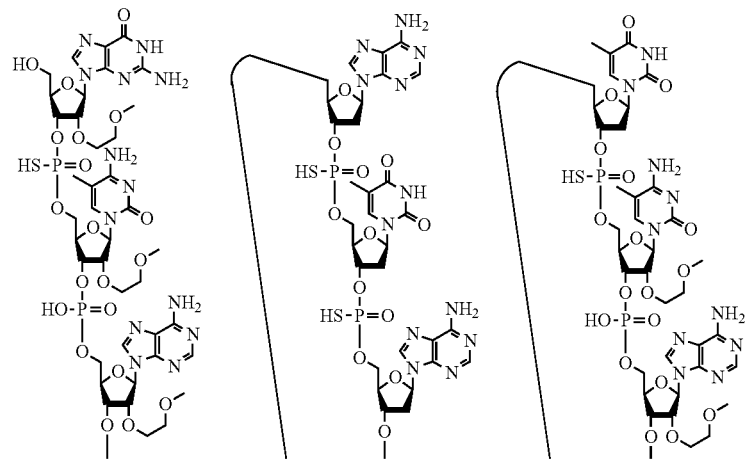
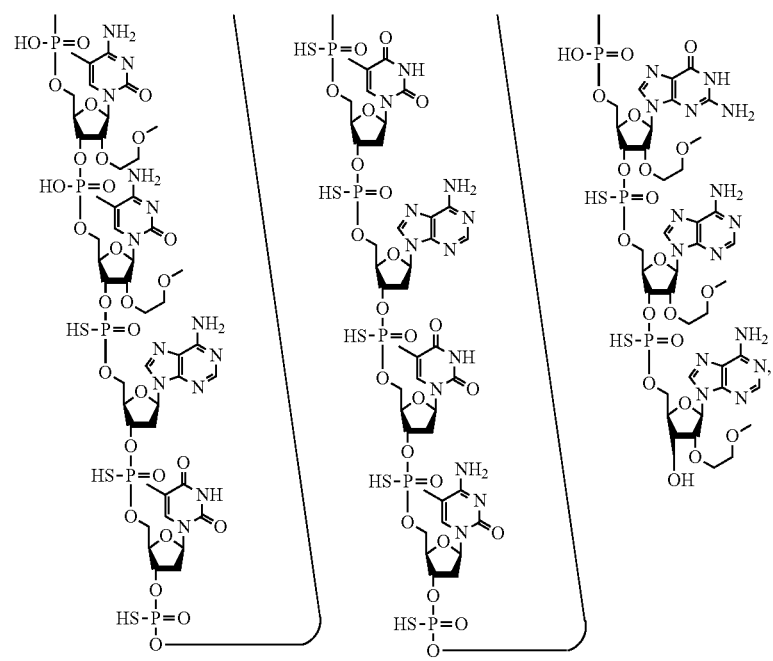
or a salt thereof.

Embodiment 52. A modified oligonucleotide according to the following chemical structure:
(SEQ ID NO: 1673)
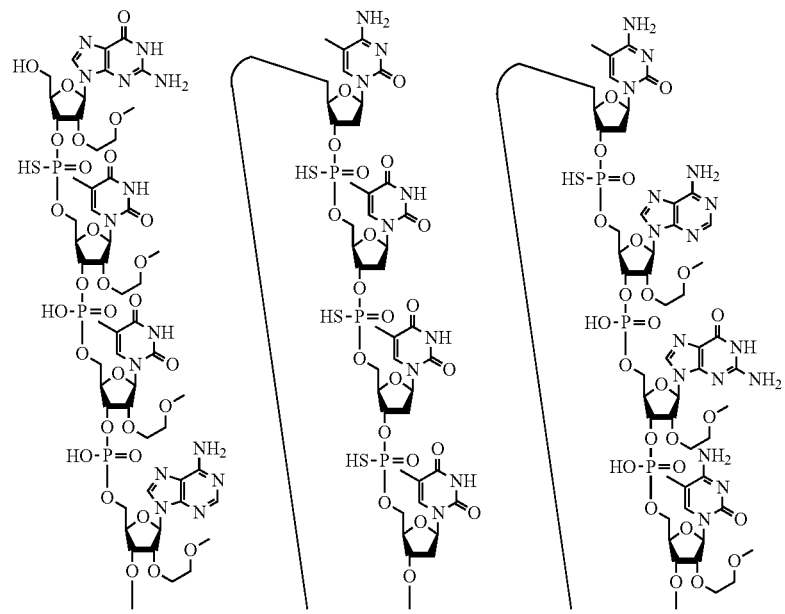
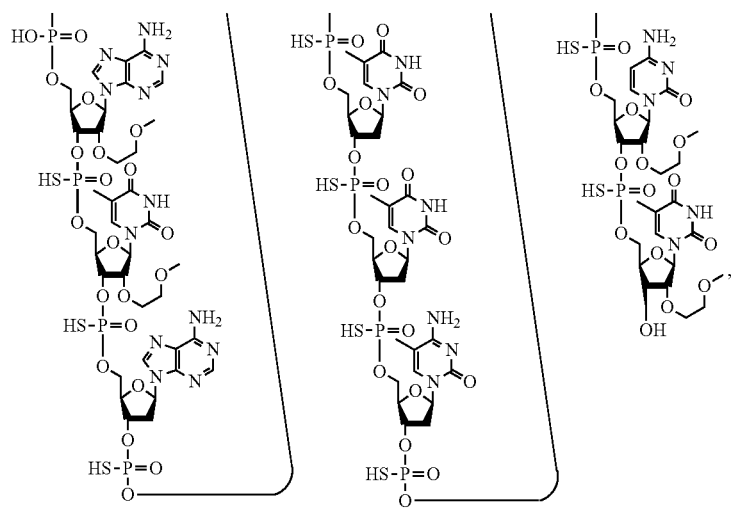
or a salt thereof.

Embodiment 53. A modified oligonucleotide according to the following chemical structure:
(SEQ ID NO: 423)
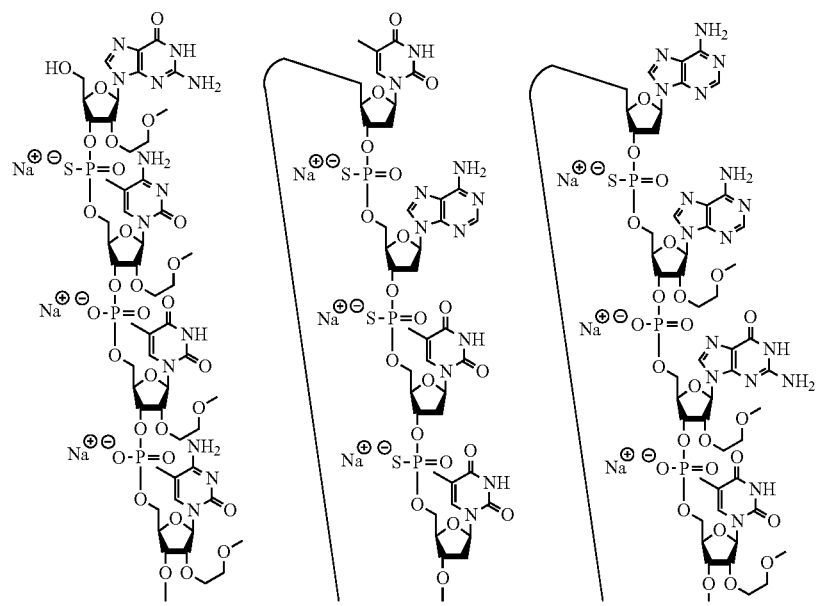
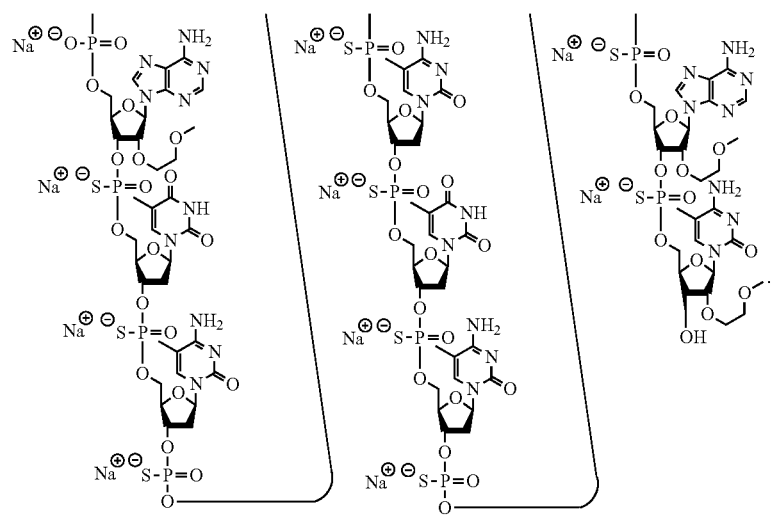

Embodiment 54. A modified oligonucleotide according to the following chemical structure:
(SEQ ID NO: 1226)
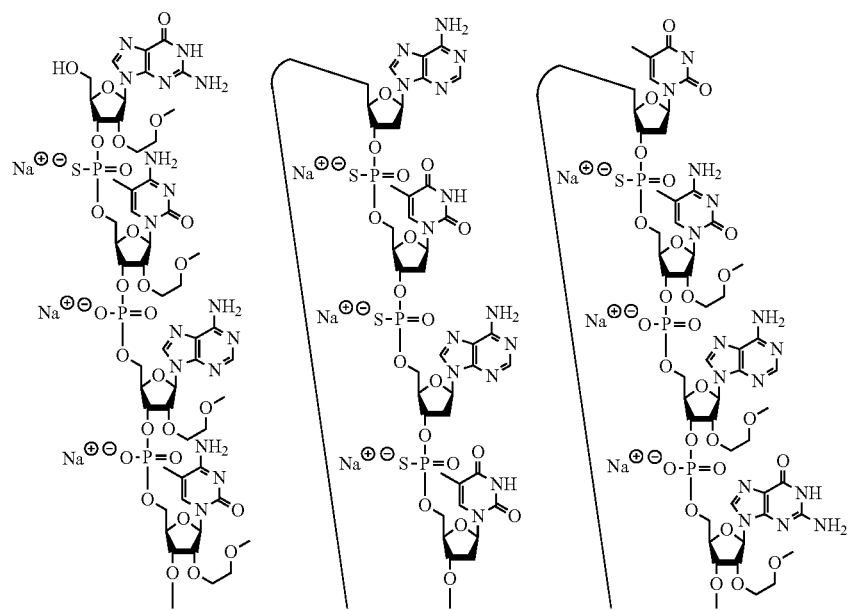
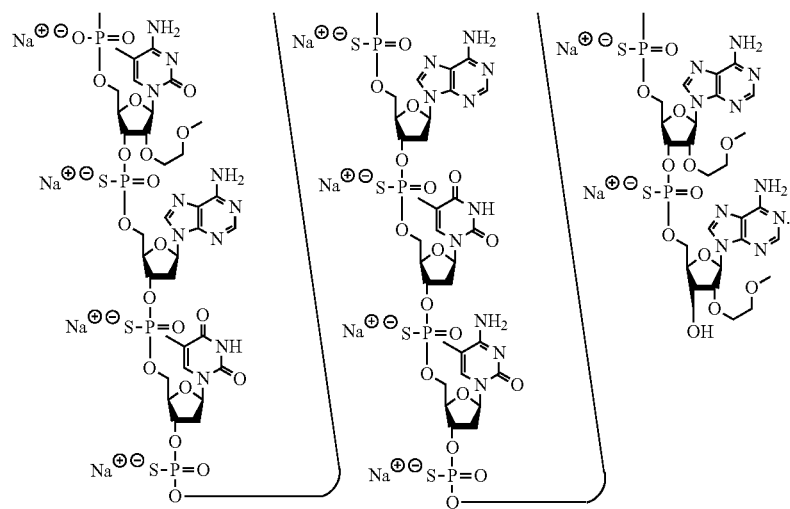

Embodiment 55. A modified oligonucleotide according to the following chemical structure:

(SEQ ID NO: 1673)

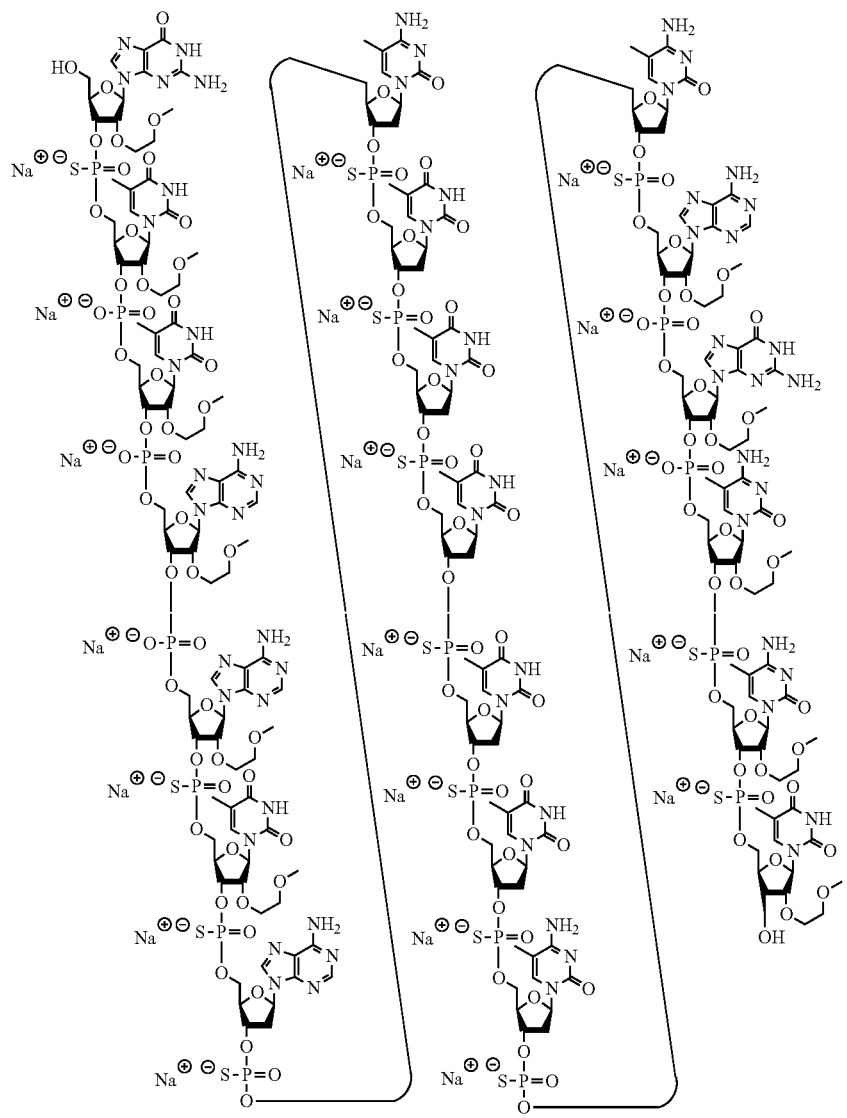

Embodiment 56. The modified oligonucleotide of any of embodiments 50, 52, or 54, which is a sodium salt of the formula.

Embodiment 57. A pharmaceutical composition comprising the modified oligonucleotide of any of embodiments 50-56 and a pharmaceutically acceptable carrier or diluent.

Embodiment 58. The pharmaceutical composition of embodiment 57, wherein the pharmaceutically acceptable diluent is artificial cerebrospinal fluid.

Embodiment 59 The pharmaceutical composition of embodiment 57, wherein the pharmaceutical composition consists essentially of the modified oligonucleotide and artificial cerebrospinal fluid.

Embodiment 60. A compound comprising a modified oligonucleotide according to the following chemical notation (5' to 3'): Ges $^{m}$Ceo Teo $^{m}$Ceo Aes Tds Tds Tds Ads Tds Tds $^{m}$Cds Tds $^{m}$Cds Ads Aeo Geo Tes Aes $^{m}$Ce (SEQ ID NO: 423), wherein, A=an adenine nucleobase,
$^{m}$C=a 5-methyl cytosine,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 61. A compound comprising a modified oligonucleotide according to the following chemical notation (5' to 3'): Ges $^{m}$Ceo Aeo $^{m}$Ceo $^{m}$Ces Ads Tds Ads Tds Ads Tds Ads Tds $^{m}$Cds Tds $^{m}$Ceo Aeo Ges Aes Ae (SEQ ID NO: 1226), wherein, A=an adenine nucleobase,
$^{m}$C=a 5-methyl cytosine,
G=a guanine nucleobase,
T=a thymine nucleobase,
e=a 2' MOE sugar moiety, d=a 2'-β-D deoxyribosyl sugar moiety,
s=a phosphorothioate internucleoside linkage, and
o=a phosphodiester internucleoside linkage.

Embodiment 62. A compound comprising a modified oligonucleotide according to the following chemical notation (5' to 3'): Ges Teo Teo Aeo Aes Tds Ads $^m$Cds Tds Tds Tds Tds Tds $^m$Cds $^m$Cds Aeo Geo $^m$Ces $^m$Ces Te (SEQ ID NO: 1673), wherein,
A=an adenine nucleobase,
$^m$C=a 5-methyl cytosine,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 63. The compound of any of embodiments 60-62, comprising the modified oligonucleotide covalently linked to a conjugate group.

Embodiment 64. The compound of any of embodiment 1-63, wherein at least one internucleoside linkage of the modified oligonucleotide is chirally controlled.

Embodiment 65. The compound of any of embodiments 1-64, wherein at least one internucleoside linkage of the modified oligonucleotide is stereorandom.

Embodiment 66. A pharmaceutical composition comprising the compound of any of embodiments 60-65 and a pharmaceutically acceptable diluent or carrier.

Embodiment 67. The pharmaceutical composition of embodiment 66, wherein the pharmaceutically acceptable diluent is artificial cerebrospinal fluid.

Embodiment 68. The pharmaceutical composition of embodiment 66, wherein the pharmaceutical composition consists essentially of the modified oligonucleotide and artificial cerebrospinal fluid.

Embodiment 69. A chirally enriched population of modified oligonucleotides of any of embodiments 50-55, wherein the population is enriched for modified oligonucleotides comprising at least one particular phosphorothioate internucleoside linkage having a particular stereochemical configuration.

Embodiment 70. The chirally enriched population of embodiment 69, wherein the population is enriched for modified oligonucleotides comprising at least one particular phosphorothioate internucleoside linkage having the (Sp) configuration.

Embodiment 71. The chirally enriched population of embodiment 69, wherein the population is enriched for modified oligonucleotides comprising at least one particular phosphorothioate internucleoside linkage having the (Rp) configuration.

Embodiment 72. The chirally enriched population of embodiment 69, wherein the population is enriched for modified oligonucleotides having a particular, independently selected stereochemical configuration at each phosphorothioate internucleoside linkage Embodiment 73. The chirally enriched population of embodiment 73, wherein the population is enriched for modified oligonucleotides having the (Sp) configuration at each phosphorothioate internucleoside linkage.

Embodiment 74. The chirally enriched population of embodiment 73, wherein the population is enriched for modified oligonucleotides having the (Rp) configuration at each phosphorothioate internucleoside linkage.

Embodiment 75. The chirally enriched population of embodiment 73, wherein the population is enriched for modified oligonucleotides having the (Rp) configuration at one particular phosphorothioate internucleoside linkage and the (Sp) configuration at each of the remaining phosphorothioate internucleoside linkages.

Embodiment 76. The chirally enriched population of embodiment 69 or embodiment 73 wherein the population is enriched for modified oligonucleotides having at least 3 contiguous phosphorothioate internucleoside linkages in the Sp, Sp, and Rp configurations, in the 5' to 3' direction.

Embodiment 77. A chirally enriched population of modified oligonucleotides of any of embodiments 50-55, wherein all of the phosphorothioate internucleoside linkages of the modified oligonucleotide are stereorandom.

I. Certain Oligonucleotides

In certain embodiments, provided herein are oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)- alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)-N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted nucleoside non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)-N(H)CH_3$ ("NMA").

In certain embodiments, a 2'-substituted non-bicyclic modified nucleoside comprises a sugar moiety comprising a non-bridging 2'-substituent group selected from: F, $OCH_3$, and $OCH_2CH_2OCH_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt"), 4'-$CH_2$—O—$CH_2$-2', 4'-$CH_2$—N(R)-2', 4'-$CH(CH_2OCH_3)$—O- 2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—N(OCH_3)-2' and analogs thereof (see, e.g., Prakash et al., U.S. Pat. No. 8,278,425), 4'-$CH_2$—O—N(CH_3)-2' (see, e.g., Allerson et al., U.S. Pat. No. 7,696,345 and Allerson et al., U.S. Pat. No. 8,124,745), 4'-$CH_2$—C(H)(CH_3)-2' (see, e.g., Zhou, et al., J. Org. Chem., 2009, 74, 118-134), 4'-$CH_2$—C($=CH_2$)-2' and analogs thereof (see e.g., Seth et al., U.S. Pat. No. 8,278,426), 4'-$C(R_aR_b)$—N(R)—O-2', 4'-$C(R_aR_b)$—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C($R_a$)($R_b$)]$_n$—, —[C($R_a$)($R_b$)]$_n$—O—, —C($R_a$)=C($R_b$)—, —C($R_a$)=N—, —C(=N$R_a$)—, —C(=O)—, —C(=S)—, —O—, —Si($R_a$)$_2$—, —S(=O)$_x$—, and —N($R_a$)—;

wherein:
x is 0, 1, or 2;
n is 1, 2, 3, or 4;
each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 20017, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

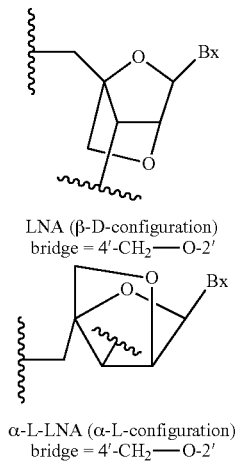

LNA (β-D-configuration)
bridge = 4'-$CH_2$——O-2'

α-L-LNA (α-L-configuration)
bridge = 4'-$CH_2$——O-2'

α-L-methyleneoxy (4'-$CH_2$—O-2') or α-L-LNA bicyclic nucleosides have been incorporated into oligonucleotides that showed antisense activity (Frieden et al., Nucleic Acids Research, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

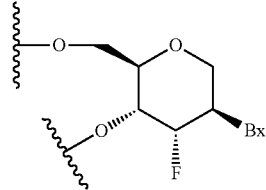

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005, 906; F-HNA can also be referred to as a F-THP or $3^1$-fluoro tetrahydropyran), and nucleosides comprising additional modified THP compounds having the formula:

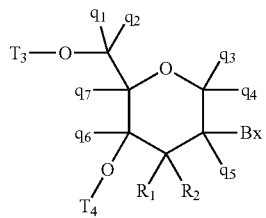

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., *Biochemistry*, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

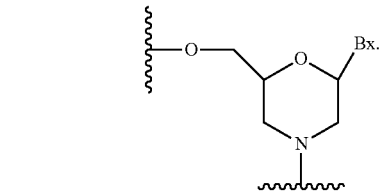

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides).

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS-P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

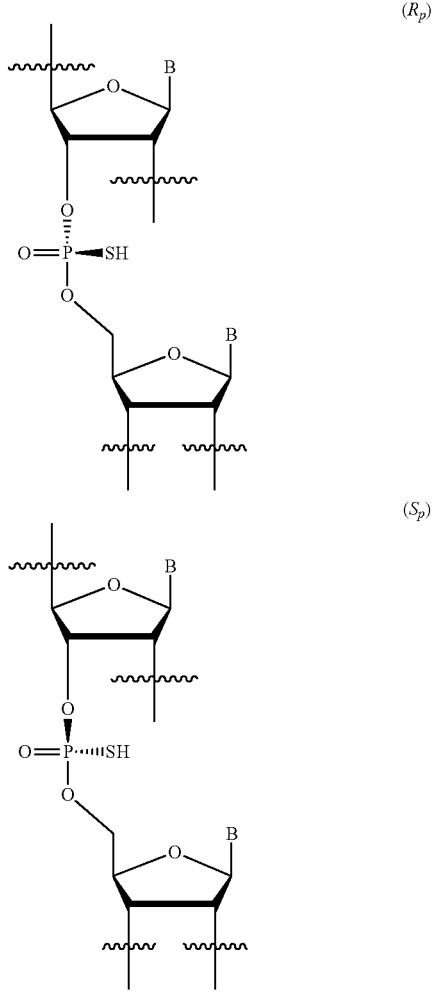

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'—CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O-CH$_2$-O-5'), methoxypropyl, and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction).

In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxy nucleoside.

In certain embodiments, the gapmer is a deoxy gapmer. In embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]–[# of nucleosides in the gap]–[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., *Proc. Natl. Acad. Sci. USA,* 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; and Nishina et al., *Molecular Therapy,* 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phophate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature RNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides that are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. ATXN3

In certain embodiments, oligomeric compounds comprise or consist of an oligonucleotide comprising a region that is complementary to a target nucleic acid, wherein the target nucleic acid is ATXN3. In certain embodiments, ATXN3 nucleic acid has the sequence set forth in SEQ ID NO: 1 (GENBANK Accession No: NM_004993.5); SEQ ID NO: 2 (the complement of GENBANK Accession No NC_000014.9 truncated from nucleotides 92,056,001 to 92,110,000); SEQ ID NO: 3 (GENBANK Accession No: NM_001164781.1); SEQ ID NO: 4 (GENBANK Accession No: NM_001127697.2); and SEQ ID NO: 5 (ensemble transcript No: ENST00000558190.5).

In certain embodiments, contacting a cell with an oligomeric compound complementary to any of SEQ ID NOs: 1-5 reduces the amount of ATXN3 RNA, and in certain embodiments reduces the amount of Ataxin-3 protein. In certain embodiments, the oligomeric compound consists of a modified oligonucleotide. In certain embodiments, contacting a cell in an animal with an oligomeric compound complementary to any of SEQ ID NOs: 1-5 ameliorate one or more symptom or hallmark of a neurodegenerative disease. In certain embodiments, the symptom or hallmark is ataxia, neuropathy, and aggregate formation. In certain embodiments, contacting a cell in an animal with an oligonucleotide complementary to any of SEQ ID Nos: 1-5 results in improved motor function, reduced neuropathy, and/or reduction in number of aggregates. In certain embodiments, the oligomeric compound consists of a modified oligonucleotide.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS), including spinal cord, cortex, cerebellum, brain stem, and pons.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain.

Under certain conditions, certain compounds disclosed herein act as acids. Although such compounds may be drawn or described in protonated (free acid) form, in ionized (anion) form, or ionized and in association with a cation (salt) form, aqueous solutions of such compounds exist in equilibrium among such forms. For example, a phosphate linkage of an oligonucleotide in aqueous solution exists in equilibrium among free acid, anion, and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salts thereof" expressly includes all such forms that may be fully or partially protonated/de-protonated/in association with a cation. In certain instances, one or more specific cation is identified.

In certain embodiments, modified oligonucleotides are in aqueous solution with sodium. In certain embodiments, modified oligonucleotides are in aqueous solution with potassium. In certain embodiments, modified oligonucleotides are in PBS. In certain embodiments, modified oligonucleotides are in water. In certain such embodiments, the pH of the solution is adjusted with NaOH and/or HCl to achieve a desired pH.

VII. Certain Compositions

1. Compound No. 1100673

In certain embodiments, Compound No. 1100673 is characterized as a 5-10-5 MOE gapmer having a sequence of (from 5' to 3') GCTCATTTATTCTCAAGTAC (SEQ ID NO: 423), wherein each of nucleosides 1-5 and 16-20 (from 5' to 3') comprise a 2'-MOE sugar moiety and each of nucleosides 6-15 are 2'β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1100673 is represented by the following chemical notation (5' to 3'): Ges $^m$Ceo Teo $^m$Ceo Aes Tds Tds Tds Ads Tds Tds $^m$Cds Tds $^m$Cds Ads Aeo Geo Tes Aes $^m$Ce (SEQ ID NO: 423), wherein, A=an adenine nucleobase,
$^m$C=a 5-methyl cytosine,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1100673 is represented by the following chemical structure:
(SEQ ID NO: 423)
Structure 1. Compound No. 1100673
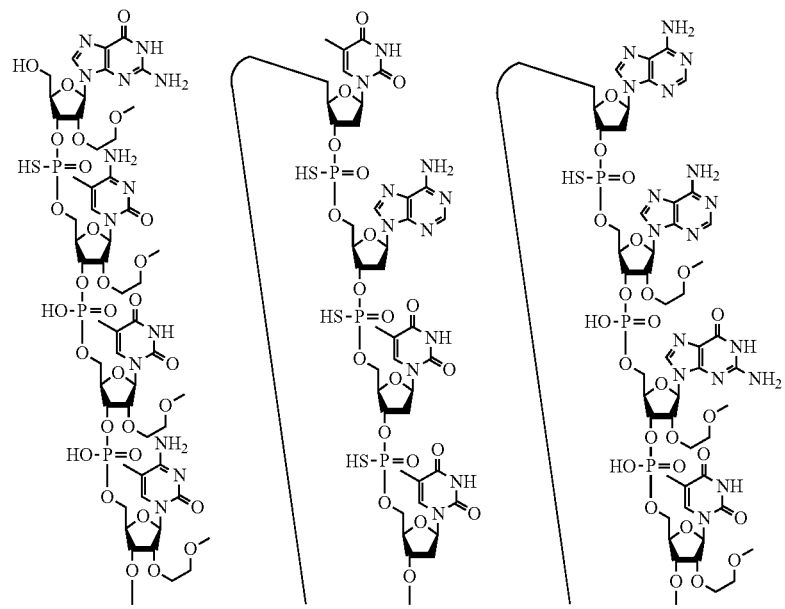
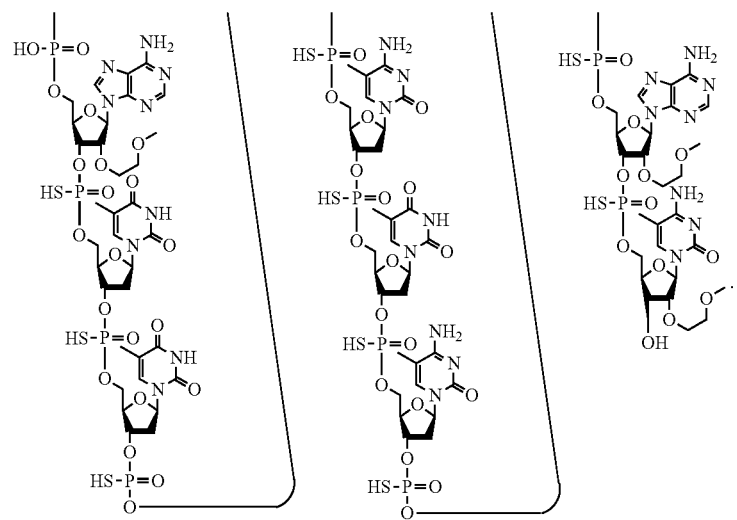

In certain embodiments, the sodium salt of Compound No. 1100673 is represented by the following chemical structure:

(SEQ ID NO: 423)

Structure 2. The sodium salt of Compound No. 1100673

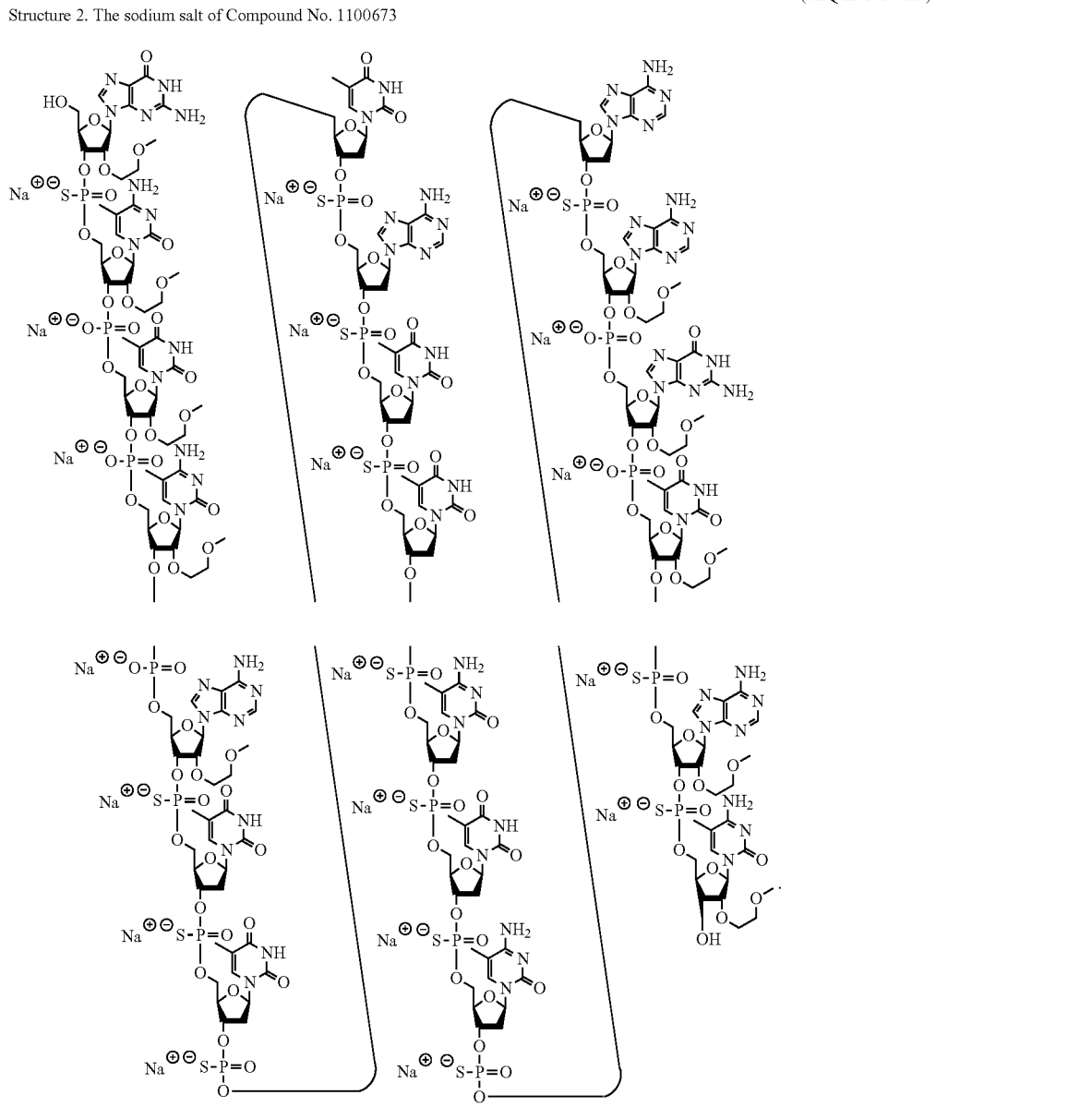

2. Compound No. 1101657

In certain embodiments, Compound No. 1101657 is characterized as a 5-10-5 MOE gapmer having a sequence of (from 5' to 3') GCACCATATATATCTCAGAA (SEQ ID NO: 1226), wherein each of nucleosides 1-5 and 16-20 (from 5' to 3') comprise a 2'-MOE sugar moiety and each of nucleosides 6-15 are 2'β-D-deoxynucleosides (from 5' to 3'), wherein the internucleoside linkages between nucleosides 2 to 3, 3 to 4, 4 to 5, 16 to 17, and 17 to 18 are phosphodiester internucleoside linkages (from 5' to 3') and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages (from 5' to 3'), and wherein each cytosine is a 5-methyl cytosine.

In certain embodiments, Compound No. 1101657 is represented by the following chemical notation (5' to 3'): Ges $^m$Ceo Aeo $^m$Ceo $^m$Ces Ads Tds Ads Tds Ads Tds Ads Tds $^m$Cds Tds $^m$Ceo Aeo Ges Aes Ae (SEQ ID NO: 1226), wherein, A=an adenine nucleobase,
$^m$C=a 5-methyl cytosine,
G=guanine nucleobase,
T=a thymine nucleobase,
e=a 2' MOE sugar moiety,
d=a 2'β-D deoxyribosyl sugar moiety,
s=phosphorothioate internucleoside linkage, and
o=a phosphodiester internucleoside linkage.

In certain embodiments, Compound No. 1101657 is represented by the following chemical structure:
(SEQ ID NO: 1226)
Structure 3. Compound No.1101657
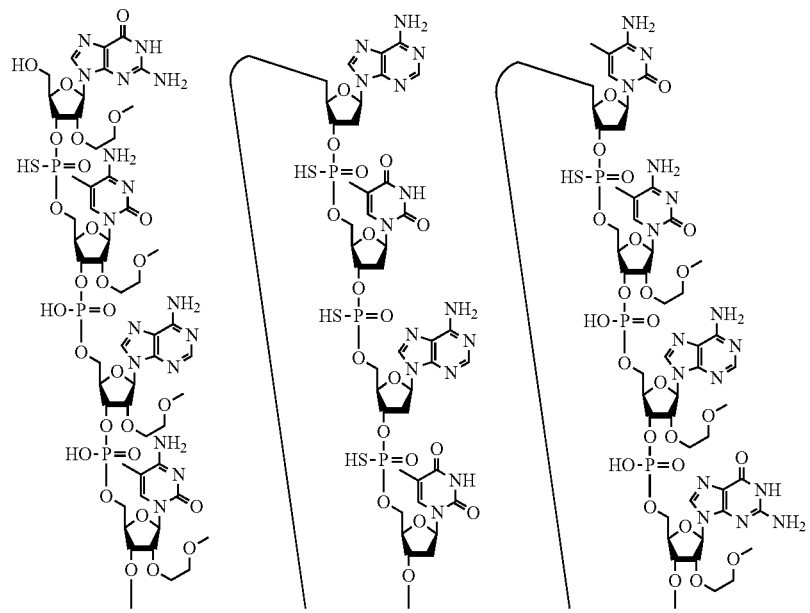
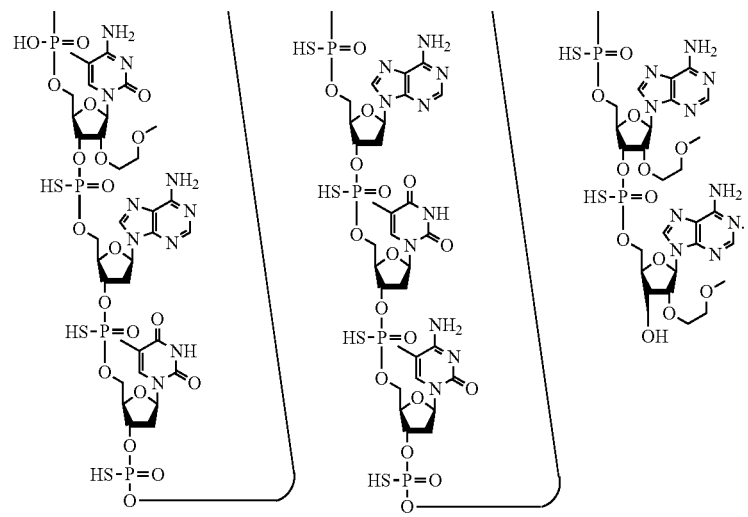

In certain embodiments, the sodium salt of Compound No. 1101657 is represented by the following chemical structure:

(SEQ ID NO: 1226)

Structure 4. The sodium salt of Compound No. 1101657

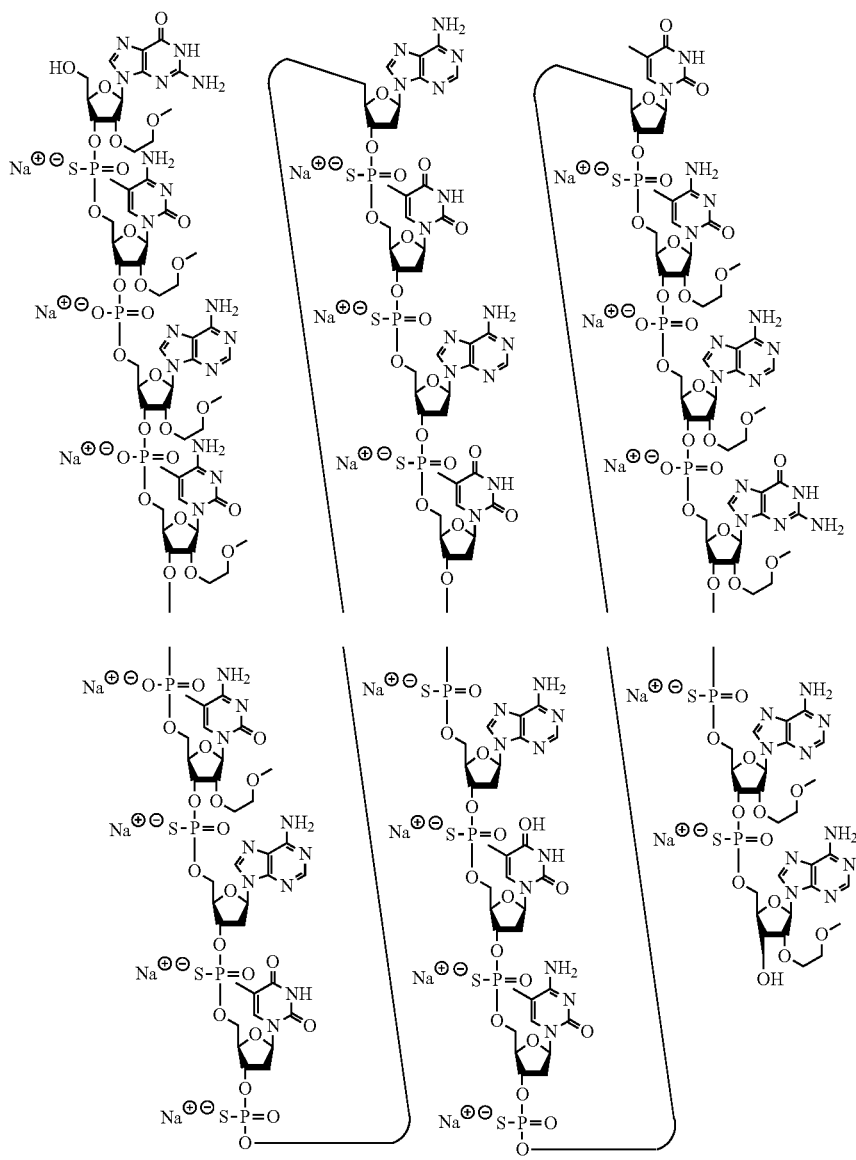

3. Compound No. 1102130

In certain embodiments, Compound No. 1102130 is characterized as a 5-10-5 MOE gapmer having a sequence of (from 5' to 3') GTTAATACTTTTTCCAGCCT (SEQ ID NO: 1673), wherein each of nucleosides 1-5 and 16-20 (from 5' to 3') comprise a 2'-MOE sugar moiety and each of nucleosides 6-15 are 2'β-D-deoxynucleosides (from 5' to 3'), wherein the internucleoside linkages between nucleosides 2 to 3, 3 to 4, 4 to 5, 16 to 17, and 17 to 18 are phosphodiester internucleoside linkages (from 5' to 3') and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages (from 5' to 3'), and wherein each cytosine is a 5-methyl cytosine.

In certain embodiments, Compound No. 1102130 is represented by the following chemical notation (5' to 3'): Ges Teo Teo Aeo Aes Tds Ads $^m$Cds Tds Tds Tds Tds Tds $^m$Cds $^m$Cds Aeo Geo $^m$Ces $^m$Ces Te (SEQ ID NO: 1673), wherein, A=an adenine nucleobase, $^m$C=a 5-methyl cytosine, G=a guanine nucleobase, T=a thymine nucleobase, e=a 2' MOE sugar moiety, d=a 2'β-D deoxyribosyl sugar moiety, s=phosphorothioate internucleoside linkage, and o=a phosphodiester internucleoside linkage.

In certain embodiments, Compound No. 1102130 is represented by the following chemical structure:
(SEQ ID NO: 1673)
Structure 5. Compound No. 1102130
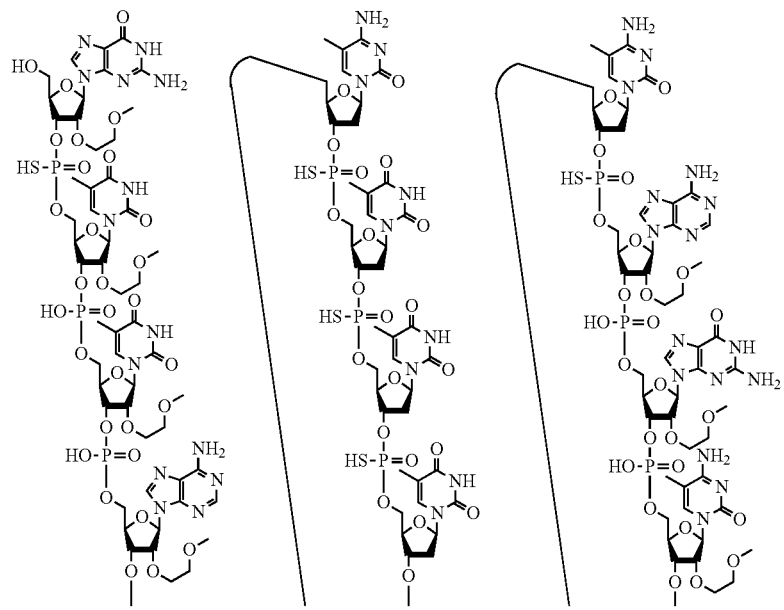
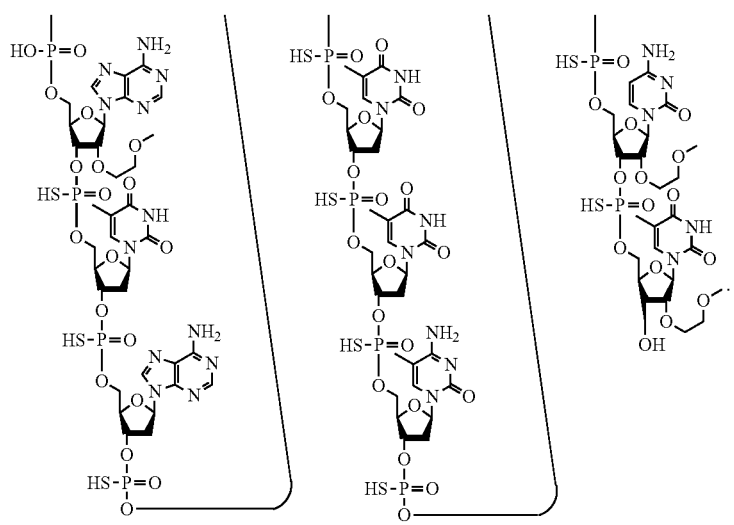

In certain embodiments, the sodium salt of Compound No. 1102130 is represented by the following chemical structure:

(SEQ ID NO: 1673)

Structure 6. The sodium salt of compound No. 1102130

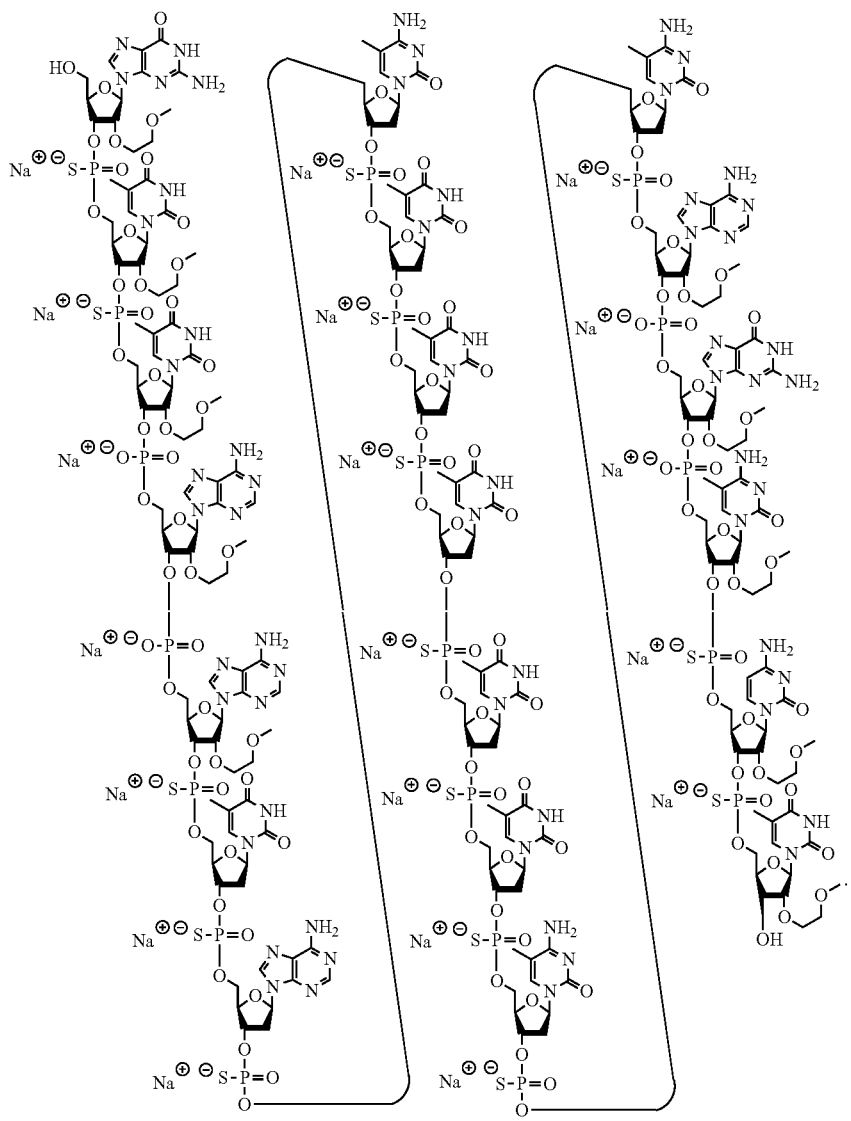

VIII. Certain Comparator Compositions

In certain embodiments, Compound No. 650528, which has been described in Moore, et al., Mol. Ther. Nucleic Acids, 2017, 7:200-210 (Moore, 2017) ("ASO-5"), WO 2018/089805, and McLoughlin et al., Ann. Neurol., 2018, 84:64-77 (McLoughlin, 2018) (each of which are incorporated herein by reference) was used as a comparator compound. Compound No. 650528 is a 5-8-5 MOE gapmer, having a sequence (from 5' to 3') GCATCTTTTCATACTGGC (SEQ ID NO: 2788), wherein each cytosine is a 5-methylcytosine, each internucleoside linkage is either a phosphodiester internucleoside linkage or a phosphorothioate internucleoside linkage and the internucleoside linkage motif is sooossssssssssooss, wherein 's' represents a phosphorothioate internucleoside linkage and 'o' represents a phosphodiester internucleoside linkage, and wherein each of nucleosides 1-5 and 14-18 comprise a 2'-MOE sugar moiety.

In certain embodiments, Compound No. 650668, which has been described in Moore, 2017 ("ASO-2"), WO 2018/089805, and McLoughlin, 2018 was used as a comparator compound. Compound No. 650668, is a 5-8-5 MOE gapmer, having a sequence (from 5' to 3') AGCCATTAATCTATACTG (SEQ ID NO: 2792), wherein each cytosine is a 5-methylcytosine, each internucleoside linkage is either a phosphodiester internucleoside linkage or a phosphorothioate internucleoside linkage and the internucleoside linkage motif is sooossssssssssooss, wherein 's' represents a phosphorothioate internucleoside linkage and 'o' represents a phosphodiester internucleoside linkage, and wherein each of nucleosides 1-5 and 14-18 comprise a 2'-MOE sugar moiety.

Compound No. 650528 and Compound No. 650668 were selected as comparator compounds because according to Moore, 2017 these compounds were "top ASO candidates" that were effective and tolerable. See, e.g., page 206, column 2, paragraph 1. In a follow up manuscript, Compound No. 650528 was further characterized as " . . . the best ASO candidate . . . [f]rom this short-term safety and efficacy study . . . " See, McLoughlin, 2018.

In certain embodiments, Compound No. 1244463 ("SH06"), which has been described in WO2013/138353 (incorporated by reference) is a comparator compound. Compound No. 1244463 is a 3-9-3 LNA gapmer, having a sequence (from 5' to 3') ATAGGTCCCGCTGCT (SEQ ID NO: 2793), and wherein each internucleoside linkage is a phosphorothioate internucleoside linkage.

In certain embodiments, Compound No. 1244464 ("SH10"), which has been described in WO2013/138353 is a comparator compound. Compound No. 1244464 is a 3-10-3 LNA gapmer, having a sequence (from 5' to 3') TGATAGGTCCCGCTGC (SEQ ID NO: 2794), and wherein each internucleoside linkage is a phosphorothioate internucleoside linkage.

In certain embodiments, Compound No. 1244465 ("SH13"), which has been described in WO2013/138353 is a comparator compound. Compound No. 1244465 is a 3-10-3 LNA gapmer, having a sequence (from 5' to 3') CTGATAGGTCCCGCTG (SEQ ID NO: 2795), and wherein each internucleoside linkage is a phosphorothioate internucleoside linkage.

In certain embodiments, Compound No. 1244466 ("SH16"), which has been described in WO2013/138353 is a comparator compound. Compound No. 1244466 is a 3-9-3 LNA gapmer, having a sequence (from 5' to 3') CTGATAGGTCCCGCT (SEQ ID NO: 2796), and wherein each internucleoside linkage is a phosphorothioate internucleoside linkage.

In certain embodiments, Compound No. 1244467 ("SH20"), which has been described in WO2013/138353 is a comparator compound. Compound No. 1244467 is a 2-9-3 LNA gapmer, having a sequence (from 5' to 3') CTGATAGGTCCCGC (SEQ ID NO: 2797), and wherein each internucleoside linkage is a phosphorothioate internucleoside linkage.

Compound No. 1244463, Compound No. 1244464, Compound No. 1244465, Compound No. 1244466, and Compound No. 1244467 were selected as comparator compounds because according to Example 2 of WO2013/138353 these compounds were selected for further study. Accordingly, these compounds were tested in further studies.

In certain embodiments, compounds described herein are superior relative to compounds described in Moore, 2017, WO 2018/089805, and WO2013/138353 because they demonstrate one or more improved properties, such as, potency and tolerability.

For example, as described herein, certain compounds Compound No. 1100673, Compound No. 1101657, and Compound No. 1102130 achieved an $IC_{50}$ in Example 7, hereinbelow, of 0.10 µM, 0.69 µM, and 0.47 µM, respectively, whereas comparator compound, Compound No. 650528 ("ASO-5") achieved an $IC_{50}$ in Example 7, hereinbelow, of 2.03 µM and Compound No. 650668 ("ASO-2") achieved an $IC_{50}$ in Example 2 of WO 2018/089805 of 1.7 µM. Therefore, certain compounds described herein are more potent than comparator compounds, Compound No. 650528 ("ASO-5") and Compound No. 650668 ("ASO-2") in this assay.

For example, as described herein, certain compounds Compound No. 1100673, Compound No. 1101657, and Compound No. 1102130 are more efficacious and potent than comparator compounds in vivo. See, e.g., Examples 4, 6, and 9, hereinbelow. For example, as provided in Examples 4 and 6, certain compounds Compound No. 1100673, Compound No. 1101657, and Compound No. 1102130 achieved an average expression level (% control) of 13%, 23%, and 27%, respectively, in spinal cord of transgenic mice whereas comparator compound, Compound No. 650528 ("ASO-5") achieved an average expression level (% control) of 32% in spinal cord of transgenic mice. For example, as provided in Examples 4 and 6, certain compounds Compound No. 1100673, Compound No. 1101657, and Compound No. 1102130 achieved an average expression level (% control) of 13%, 23%, and 42%, respectively, in cortex of transgenic mice whereas comparator compound, Compound No. 650528 ("ASO-5") achieved an average expression level (% control) of 43% in cortex of transgenic mice. For example, as provided in Examples 4 and 6, certain compounds Compound No. 1100673, Compound No. 1101657, and Compound No. 1102130 achieved an average expression level (% control) of 60%, 62%, and 68%, respectively, in cerebellum of transgenic mice whereas comparator compound, Compound No. 650528 ("ASO-5") achieved an average expression level (% control) of 75% in cerebellum of transgenic mice. For example, as provided in Examples 4 and 6, certain compounds Compound No. 1100673, Compound No. 1101657, and Compound No. 1102130 achieved an average expression level (% control) of 14%, 26%, and 23%, respectively, in brain stem of transgenic mice whereas comparator compound, Compound No. 650528 ("ASO-5") achieved an average expression level (% control) of 35% in brain stem of transgenic mice. Therefore, certain compounds described herein are more efficacious than comparator compound, Compound No. 650528 ("ASO-5") in this assay. Specifically, certain compounds Compound No. 1100673, Compound No. 1101657, and Compound No. 1102130 are more efficacious than Compound No. 650528 ("ASO-5") in every tissue tested in this assay. For example, as described herein, certain compounds Compound No. 1100673, Compound No. 1101657, and Compound No. 1102130 achieved 3-hour FOB scores in mice of 1.00 (table 9) and 0.00 (table 20), 1.00 (table 9) and 0.00 (table 20), and 0.00 (table 8 and table 20), respectively, whereas each of comparator compounds Compound No. 1244463, Compound No. 1244464, Compound No. 1244465, Compound No. 1244466, and Compound No. 1244447 achieved 3-hour FOB scores in mice of 7.00 (table 26). Therefore, certain compounds described herein are more tolerable than comparator compounds Compound No. 1244463, Compound No. 1244464, Compound No. 1244465, Compound No. 1244466, and Compound No. 1244447 in this assay.

IX. Certain Hotspot Regions

1. Nucleobases 138-175 of SEQ ID NO: 1

In certain embodiments, nucleobases 138-175 of SEQ ID NO: 1 comprise a hotspot region. In certain embodiments, modified oligonucleotides are complementary to nucleobases 138-175 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages.

The nucleobase sequences of SEQ ID Nos: 1060, 1061, 1062, 1063, 1064, and 1065 are complementary to nucleobases 138-175 of SEQ ID NO: 1.

In certain embodiments, modified oligonucleotides complementary to nucleobases 138-175 of SEQ ID NO: 1 achieve at least 79% reduction of ATXN3 RNA in vitro in the standard cell assay.

2. Nucleobases 392-436 of SEQ ID NO: 1

In certain embodiments, nucleobases 392-436 of SEQ ID NO: 1 comprise a hotspot region. In certain embodiments, modified oligonucleotides are complementary to nucleobases 392-436 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 196, 197, 198,199, 200, 201, 202, 203, 204, 205, 206, 207, 208, 209 are complementary to nucleobases 392-436 of SEQ ID NO 1.

In certain embodiments, modified oligonucleotides complementary to nucleobases 392-436 of SEQ ID NO: 1 achieve an average of 77% reduction of ATXN3 RNA in vitro in the standard cell assay.

3. Nucleobases 1120-1146 of SEQ ID NO: 1

In certain embodiments, nucleobases 1120-1146 of SEQ ID NO: 1 comprise a hotspot region. In certain embodiments, modified oligonucleotides are complementary to nucleobases 1120-1146 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 313, 314, 315, 316, and 317 are complementary to nucleobases 1120-1146 of SEQ ID NO: 1.

In certain embodiments, modified oligonucleotides complementary to nucleobases 1120-1146 of SEQ ID NO: 1 achieve at least 60% reduction of ATXN3 RNA in vitro in the standard cell assay.

4. Nucleobases 1823-1882 of SEQ ID NO:1

In certain embodiments, nucleobases 1823-1882 of SEQ ID NO: 1 comprise a hotspot region. In certain embodiments, modified oligonucleotides are complementary to nucleobases 1823-1882 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 413-423 are complementary to nucleobases 1823-1882 of SEQ ID NO: 1.

In certain embodiments, modified oligonucleotides complementary to nucleobases 1823-1882 of SEQ ID NO: 1 achieve at least 60% reduction of ATXN3 RNA in vitro in the standard cell assay.

5. Nucleobases 3042-3098 of SEQ ID NO: 1

In certain embodiments, nucleobases 3042-3098 of SEQ ID NO: 1 comprise a hotspot region. In certain embodiments, modified oligonucleotides are complementary to nucleobases 3042-3098 of SEQ ID NO: 1. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos:43, 44, 45, and 635-653 are complementary to nucleobases 3042-3098 of SEQ ID NO: 1.

In certain embodiments, modified oligonucleotides complementary to nucleobases 3042-3098 of SEQ ID NO: 1 achieve at least 64% reduction of ATXN3 RNA in vitro in the standard cell assay.

6. Nucleobases 3749-3801 of SEQ ID NO: 1

In certain embodiments, nucleobases 3749-3801 of SEQ ID NO: 1 comprise a hotspot region. In certain embodiments, modified oligonucleotides are complementary to nucleobases 3749-3801 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 719-732 are complementary to nucleobases 3749-3801 of SEQ ID NO: 1.

In certain embodiments, modified oligonucleotides complementary to nucleobases 3749-3801 of SEQ ID NO: 1 achieve at least 52% reduction of ATXN3 RNA in vitro in the standard cell assay.

7. Nucleobases 5997-6021 of SEQ ID NO: 1

In certain embodiments, nucleobases 5997-6021 of SEQ ID NO: 1 comprise a hotspot region. In certain embodiments, modified oligonucleotides are complementary to nucleobases 5997-6021 of SEQ ID NO: 1. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 920-924 are complementary to nucleobases 5997-6021 of SEQ ID NO: 1.

In certain embodiments, modified oligonucleotides complementary to nucleobases 5997-6021 of SEQ ID NO: 2 achieve at least 75% reduction of ATXN3 RNA in vitro in the standard cell assay.

8. Nucleobases 19437-19476 of SEQ ID NO: 2

In certain embodiments, nucleobases 19437-19476 of SEQ ID NO: 2 comprise a hotspot region. In certain embodiments, modified oligonucleotides are complementary to nucleobases 19437-19476 of SEQ ID NO: 2. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos: 1671, 1672, 1673, and 1674 are complementary to nucleobases 19437-19476 of SEQ ID NO: 2.

In certain embodiments, modified oligonucleotides complementary to nucleobases 19437-19476 of SEQ ID NO: 2 achieve at least 83% reduction of ATXN3 RNA in vitro in the standard cell assay.

9. Nucleobases 34440-34486 of SEQ ID NO: 2

In certain embodiments, nucleobases 34440-34486 of SEQ ID NO: 2 comprise a hotspot region. In certain embodiments, modified oligonucleotides are complementary to nucleobases 34440-34486 of SEQ ID NO: 2. In certain embodiments, modified oligonucleotides are 20 nucleobases in length. In certain embodiments, modified oligonucleotides are gapmers. In certain embodiments, the gapmers are MOE gapmers. In certain embodiments, the nucleosides of the modified oligonucleotides are linked by phosphorothioate internucleoside linkages and phosphodiester internucleoside linkages.

The nucleobase sequences of SEQ ID Nos: 2233, 2234, 2235, 2236, and 2237 are complementary to nucleobases 34440-34486 of SEQ ID NO: 2.

In certain embodiments, modified oligonucleotides complementary to nucleobases 34440-34486 of SEQ ID NO: 2 achieve at least 71% reduction of ATXN3 RNA in vitro in the standard cell assay.

10. Nucleobases 39883-39904 of SEQ ID NO: 2

In certain embodiments, nucleobases 39883-39904 of SEQ ID NO: 2 comprise a hotspot region. In certain embodiments, modified oligonucleotides are complementary to nucleobases 39860-39904 of SEQ ID NO: 2. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos: 2510, 2511, and 2512 are complementary to nucleobases 39883-39904 of SEQ ID NO: 2.

In certain embodiments, modified oligonucleotides complementary to nucleobases 39883-39904 of SEQ ID NO: 2 achieve at least 89% reduction of ATXN3 RNA in vitro in the standard cell assay.

11. Nucleobases 6597-6618 of SEQ ID NO: 2

In certain embodiments, nucleobases 6597-6618 of SEQ ID NO: 2 comprise a hotspot region. In certain embodiments, modified oligonucleotides are complementary to nucleobases 6597-6618 of SEQ ID NO: 2. In certain embodiments, modified oligonucleotides are 20 nucleobases in length. In certain embodiments, modified oligonucleotides are gapmers. In certain embodiments, the gapmers are MOE. In certain embodiments, the nucleosides of the modified oligonucleotides are linked by phosphorothioate internucleoside linkages and phosphodiester internucleoside linkages.

The nucleobase sequences of SEQ ID Nos: 1226, 1227, and 1228 are complementary to nucleobases 6597-6618 of SEQ ID NO: 2.

In certain embodiments, modified oligonucleotides complementary to nucleobases 6597-6618 of SEQ ID NO: 2 achieve at least 75% reduction of ATXN3 RNA in vitro in the standard cell assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein mC indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as a or such as for sugar anomers, or as (D) or (L), such as for amino acids, etc.

Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-10-5 MOE Gapmers with Mixed Internucleoside Linkages on Human ATXN3 In Vitro, Single Dose Modified oligonucleotides complementary to a human ATXN3 nucleic acid were designed and tested for their effect on ATXN3 RNA in vitro. The modified oligonucleotides were tested in a series of experiments that had similar culture conditions.

Cultured A431 cells at a density of 10,000 cells per well were transfected by free uptake with 4,000 nM concentration of modified oligonucleotide or no modified oligonucleotide for untreated controls. After approximately 24 hours, RNA was isolated from the cells and ATXN3 RNA levels were measured by quantitative real-time PCR Human primer probe set RTS38920 (forward sequence CTATCAGGACAGAGTTCACATCC, designated herein as SEQ ID NO: 6; reverse sequence GTTTCTAAAGACATGGTCACAGC, designated herein as SEQ ID NO: 7; probe sequence AAAGGCCAGCCACCAGTTCAGG, designated herein as SEQ ID: 8) was used to measure RNA levels. ATXN3 RNA levels were adjusted according to total RNA content, as measured by RiboGreen®. Results are presented in the table below as percent ATXN3 RNA levels relative to untreated control cells. The modified oligonucleotides marked with an asterisk (*) target the amplicon region of the primer probe set. Additional assays may be used to measure the potency and efficacy of oligonucleotides targeting the amplicon region.

The modified oligonucleotides in the tables below are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides each. The sugar motif for the gapmers is (from 5' to 3'): eeeeedddddddddeeeee; wherein 'd' represents a 2'-deoxyribose sugar and 'e' represents a 2'-MOE modified sugar. All cytosine residues throughout each gapmer are 5-methyl cytosines. The internucleoside linkages are mixed phosphodiester and phosphorothioate linkages. The internucleoside linkage motif for the gapmers is (from 5' to 3'): sooosssssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the tables below is complementary to human ATXN3 nucleic acid sequences SEQ ID No: 1, SEQ ID No: 2, SEQ ID No: 3, SEQ ID No: 4, or SEQ ID No: 5, as indicated. 'N/A' indicates that the modified oligonucleotide is not complementary to that particular nucleic acid sequence with 100% complementarity. As shown below, modified oligonucleotides complementary to human ATXN3 reduced the amount of human ATXN3 RNA.

TABLE 1

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1100357 | 15 | 34 | 3394 | 3413 | ACCACCCCTCCAGCTCCGC | 88 | 15 |
| 1100359 | 17 | 36 | 3396 | 3415 | GAACCACCCCTCCAGCTCC | 83 | 16 |
| 1100393 | 383 | 402 | N/A | N/A | TGATCTTTCATTTATAGGAT | 86 | 17 |
| 1100395 | 385 | 404 | N/A | N/A | AATGATCTTTCATTTATAGG | 74 | 18 |
| 1100429 | 458 | 477 | 21185 | 21204 | GAGAGAATTCAAGTTAAACC | 25 | 19 |
| 1100431 | 470 | 489 | 21197 | 21216 | TGGACCCGTCAAGAGAGAAT | 35 | 20 |
| 1100465 | 638 | 657 | 26836 | 26855 | TAATTCTTCTCCAATAAGTT | 101 | 21 |
| 1100467 | 641 | 660 | 26839 | 26858 | TGCTAATTCTTCTCCAATAA | 92 | 22 |
| 1100501 | 812 | 831 | 27669 | 27688 | CTGAATAGCCCTGCGGAGAT | 82 | 23 |
| 1100503 | 819 | 838 | 27676 | 27695 | TACTTAGCTGAATAGCCCTG | 99 | 24 |
| 1100573 | 1222 | 1241 | 45748 | 45767 | TGACACATTACCAAAGTGGA | 52 | 25 |
| 1100575 | 1225 | 1244 | 45751 | 45770 | CTTTGACACATTACCAAAGT | 94 | 26 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1100609 | 1562 | 1581 | 46088 | 46107 | TGGTTAATAAGAAATGAAAG | 79 | 27 |
| 1100611 | 1566 | 1585 | 46092 | 46111 | AATTTGGTTAATAAGAAATG | 87 | 28 |
| 1100645 | 1758 | 1777 | 46284 | 46303 | AAAAGATTACCATCTTTCAA | 64 | 29 |
| 1100647 | 1760 | 1779 | 46286 | 46305 | AGAAAAGATTACCATCTTTC | 84 | 30 |
| 1100681 | 2005 | 2024 | 46531 | 46550 | TCCTAGTTTTCTCAATTGGA | 94 | 31 |
| 1100683 | 2007 | 2026 | 46533 | 46552 | TCTCCTAGTTTTCTCAATTG | 57 | 32 |
| 1100717 | 2211 | 2230 | 46737 | 46756 | CAAGCTATACCTACTAAAAG | 76 | 33 |
| 1100719 | 2213 | 2232 | 46739 | 46758 | GACAAGCTATACCTACTAAA | 22 | 34 |
| 1100753 | 2319 | 2338 | 46845 | 46864 | CCATTGTTCTTAAGCTATCT | 27 | 35 |
| 1100755 | 2348 | 2367 | 46874 | 46893 | ATTTATAGATCCACTAAGTA | 85 | 36 |
| 1100789 | 2540 | 2559 | 47066 | 47085 | AGCTTATGAACAATTCAACA | 31 | 37 |
| 1100791 | 2545 | 2564 | 47071 | 47090 | ATTTTAGCTTATGAACAATT | 78 | 38 |
| 1100825 | 2659 | 2678 | 47185 | 47204 | TTAGCAATAAATCCTAGATC | 59 | 39 |
| 1100827 | 2661 | 2680 | 47187 | 47206 | AGTTAGCAATAAATCCTAGA | 39 | 40 |
| 1100861 | 2896 | 2915 | 47422 | 47441 | GAGGGAGTAGTACTAAACTC | 57 | 41 |
| 1100863 | 2911 | 2930 | 47437 | 47456 | AGCTTTTTAAATCTTGAGGG | 21 | 42 |
| 1100897 | 3042 | 3061 | 47568 | 47587 | GCTCATCAATTCAAGTGTAT | 31 | 43 |
| 1100899 | 3044 | 3063 | 47570 | 47589 | TAGCTCATCAATTCAAGTGT | 31 | 44 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 7 | 45 |
| 1100934 | 3539 | 3558 | 48065 | 48084 | AAACACATTCAAACGCATCC | 69 | 46 |
| 1100936 | 3541 | 3560 | 48067 | 48086 | ACAAACACATTCAAACGCAT | 65 | 47 |
| 1100970 | 3665 | 3684 | 48191 | 48210 | TGGCCAATCAATTAAGAAAT | 93 | 48 |
| 1100972 | 3671 | 3690 | 48197 | 48216 | TCATACTGGCCAATCAATTA | 68 | 49 |
| 1101006 | 3792 | 3811 | 48318 | 48337 | TTAGTTGTTCCTGACTTTCT | 59 | 50 |
| 1101008 | 3803 | 3822 | 48329 | 48348 | TTCTTGTGAATTTAGTTGTT | 43 | 51 |
| 1101042 | 3918 | 3937 | 48444 | 48463 | GTAATACAAATTATACATTA | 104 | 52 |
| 1101044 | 3921 | 3940 | 48447 | 48466 | CCAGTAATACAAATTATACA | 53 | 53 |
| 1101078 | 4010 | 4029 | 48536 | 48555 | ACTCATTAAATCCATGACAT | 53 | 54 |
| 1101080 | 4012 | 4031 | 48538 | 48557 | TTACTCATTAAATCCATGAC | 62 | 55 |
| 1101114 | 4123 | 4142 | 48649 | 48668 | CAGCCTTTTCAAACAGTTTA | 39 | 56 |
| 1101116 | 4125 | 4144 | 48651 | 48670 | AGCAGCCTTTTCAAACAGTT | 31 | 57 |
| 1101150 | 4402 | 4421 | 48928 | 48947 | TAGTATCAAAAATTCAGACA | 90 | 58 |
| 1101152 | 4757 | 4776 | 49283 | 49302 | GTTTTAAGAATTTAGTAGCT | 71 | 59 |
| 1101186 | 5957 | 5976 | 50483 | 50502 | TCGATACAACAAACAATTCA | 62 | 60 |
| 1101188 | 5959 | 5978 | 50485 | 50504 | ACTCGATACAACAAACAATT | 80 | 61 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1101222 | 6143 | 6162 | 50669 | 50688 | GACTAAAAAAATACAAAGCC | 78 | 62 |
| 1101224 | 6200 | 6219 | 50726 | 50745 | TCAATAATCTTCACTCATGA | 87 | 63 |
| 1101258 | 6539 | 6558 | 51065 | 51084 | ACATTTAAAAATGTATGTTT | 83 | 64 |
| 1101260 | 6551 | 6570 | 51077 | 51096 | AATTAGATAATCACATTTAA | 102 | 65 |
| 1101294 | 6660 | 6679 | 51186 | 51205 | GCCAAACAACAATGCTTTTT | 58 | 66 |
| 1101296 | 6662 | 6681 | 51188 | 51207 | TGGCCAAACAACAATGCTTT | 93 | 67 |
| 1101330 | 6882 | 6901 | 51408 | 51427 | ATTTAATAATCTTTGATATT | 76 | 68 |
| 1101332 | 6890 | 6909 | 51416 | 51435 | TTATCTTTATTTAATAATCT | 87 | 69 |
| 1101366 | 207 | 226 | 13276 | 13295 | CTCCTCCTTCTGCCATTCTC | 57 | 70 |
| 1101368 | 212 | 231 | 13281 | 13300 | AGTAACTCCTCCTTCTGCCA | 43 | 71 |
| 1101438 | N/A | N/A | 53335 | 53354 | CTACCCTAATACAAGAGACT | 108 | 72 |
| 1101440 | N/A | N/A | 53468 | 53487 | AAACCCTACAAATACTGAAT | 102 | 73 |
| 1101582 | N/A | N/A | 4112 | 4131 | AACCAAACCCAAACATCCCG | 59 | 74 |
| 1101584 | N/A | N/A | 4114 | 4133 | GAAACCAAACCCAAACATCC | 87 | 75 |
| 1101618 | N/A | N/A | 4906 | 4925 | TCAGCCTATTTCAAAAGTTT | 100 | 76 |
| 1101620 | N/A | N/A | 4954 | 4973 | AAAATTAGTGACAACTATAC | 78 | 77 |
| 1101654 | N/A | N/A | 6579 | 6598 | AAACTCAAAGCCATCTCTTT | 80 | 78 |
| 1101656 | N/A | N/A | 6594 | 6613 | CCATATATATCTCAGAAACT | 84 | 79 |
| 1101690 | N/A | N/A | 7113 | 7132 | AAGTCATTTATACAGAATTT | 69 | 80 |
| 1101692 | N/A | N/A | 7146 | 7165 | CAGAGGTTTCAAAACCTGTG | 73 | 81 |
| 1101726 | N/A | N/A | 8509 | 8528 | TTATCTCAAACTATCCCCAG | 91 | 82 |
| 1101728 | N/A | N/A | 8512 | 8531 | CCCTTATCTCAAACTATCCC | 99 | 83 |
| 1101762 | N/A | N/A | 9034 | 9053 | AGTTTACAAACTATGGTCAC | 79 | 84 |
| 1101764 | N/A | N/A | 9037 | 9056 | TGGAGTTTACAAACTATGGT | 37 | 85 |
| 1101798 | N/A | N/A | 9800 | 9819 | TAACCAATAATAACTAATAA | 87 | 86 |
| 1101800 | N/A | N/A | 9807 | 9826 | ATTGGTATAACCAATAATAA | 110 | 87 |
| 1101834 | N/A | N/A | 11212 | 11231 | CTGTCCCAAACAACCCTGGA | 88 | 88 |
| 1101836 | N/A | N/A | 11217 | 11236 | CAGAACTGTCCCAAACAACC | 85 | 89 |
| 1101870 | N/A | N/A | 12035 | 12054 | TTACATGATCAAAAATTTAA | 85 | 90 |
| 1101872 | N/A | N/A | 12070 | 12089 | TTTATTTTACAAATCTACCA | 88 | 91 |
| 1101906 | N/A | N/A | 14226 | 14245 | ACGGTGAAACCCCACTATCT | 79 | 92 |
| 1101908 | N/A | N/A | 14332 | 14351 | CTATATAAAAATCTAGTACT | 102 | 93 |
| 1101942 | N/A | N/A | 15045 | 15064 | ATAAACAAAGATATCTGCAG | 98 | 94 |
| 1101944 | N/A | N/A | 15201 | 15220 | AGCAAGGCACAAATAGGAAA | 95 | 95 |
| 1101978 | N/A | N/A | 15710 | 15729 | ATATATCACTAAATCCATAA | 75 | 96 |
| 1101980 | N/A | N/A | 15713 | 15732 | TAGATATATCACTAAATCCA | 77 | 97 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1102014 | N/A | N/A | 16642 | 16661 | ATTAACTTGAAATATTGAAT | 110 | 98 |
| 1102016 | N/A | N/A | 16674 | 16693 | ATCTTTCATTTCTAAAAAAG | 83 | 99 |
| 1102050 | N/A | N/A | 17448 | 17467 | TGACACTATTTCAGGCTTTG | 7 | 100 |
| 1102052 | N/A | N/A | 17466 | 17485 | GAATGCTTTATTCATGCTTG | 31 | 101 |
| 1102086 | N/A | N/A | 18832 | 18851 | TAAGAAAGAACCAACTTAGG | 85 | 102 |
| 1102088 | N/A | N/A | 18841 | 18860 | GAAGAACTTTAAGAAAGAAC | 83 | 103 |
| 1102122 | N/A | N/A | 19392 | 19411 | TAGTGAAAATATAGTTTTA | 112 | 104 |
| 1102124 | N/A | N/A | 19394 | 19413 | TATAGTGAAAATATAGTTT | 90 | 105 |
| 1102158 | N/A | N/A | 19863 | 19882 | ACATTTTTTAAAAGAGATG | 108 | 106 |
| 1102160 | N/A | N/A | 19882 | 19901 | TCACATATAACATATAAACA | 75 | 107 |
| 1102194 | N/A | N/A | 20985 | 21004 | CTGCAGATTTATCACTATTA | 71 | 108 |
| 1102196 | N/A | N/A | 21009 | 21028 | GATCTTAAAAACTACAAGAG | 69 | 109 |
| 1102230 | N/A | N/A | 22011 | 22030 | CGAGTCAGATCCTAAAATCA | 77 | 110 |
| 1102232 | N/A | N/A | 22184 | 22203 | GGTGGTAGTTAAAGAGTAAT | 74 | 111 |
| 1102266 | N/A | N/A | 22927 | 22946 | TAACGGAAAGCCACAAGGAA | 103 | 112 |
| 1102268 | N/A | N/A | 22966 | 22985 | GAACATAATTTTAATTGCTT | 65 | 113 |
| 1102302 | N/A | N/A | 23986 | 24005 | GTATCTAAAATCAAAGAATT | 81 | 114 |
| 1102304 | N/A | N/A | 23989 | 24008 | CAAGTATCTAAAATCAAAGA | 89 | 115 |
| 1102338 | N/A | N/A | 25018 | 25037 | ATGGAAAACCTCAAAATAGT | 81 | 116 |
| 1102340 | N/A | N/A | 25428 | 25447 | TTTAAGTTTCTCTATCATTA | 87 | 117 |
| 1102374 | N/A | N/A | 25709 | 25728 | GTGTGCAATAACTAGTAACA | 33 | 118 |
| 1102376 | N/A | N/A | 25807 | 25826 | TACATTACCCTTCATATATA | 77 | 119 |
| 1102410 | N/A | N/A | 26869 | 26888 | GCCTCATTTTTACCTTTGCT | 64 | 120 |
| 1102412 | N/A | N/A | 26871 | 26890 | AGGCCTCATTTTTACCTTTG | 104 | 121 |
| 1102446 | N/A | N/A | 27823 | 27842 | AAGGGAAAGCCCACTATATA | 90 | 122 |
| 1102448 | N/A | N/A | 27834 | 27853 | TAAGAAATCTAAAGGGAAAG | 93 | 123 |
| 1102482 | N/A | N/A | 28191 | 28210 | TTAACATTTTTCTTTGCCTA | 76 | 124 |
| 1102484 | N/A | N/A | 28228 | 28247 | ACTTCAAACTTTTAATTAAG | 86 | 125 |
| 1102518 | N/A | N/A | 28890 | 28909 | AATCACTGTATTTACCAATT | 99 | 126 |
| 1102520 | N/A | N/A | 28901 | 28920 | CAACAAAAACCAATCACTGT | 98 | 127 |
| 1102554 | N/A | N/A | 29810 | 29829 | GAGTTGATCCAGATTTATGG | 41 | 128 |
| 1102556 | N/A | N/A | 29863 | 29882 | GGAATTCCTATTTAGCAAGC | 78 | 129 |
| 1102590 | N/A | N/A | 30581 | 30600 | TAGAAATATCTCACATTAAG | 70 | 130 |
| 1102592 | N/A | N/A | 30586 | 30605 | AAGACTAGAAATATCTCACA | 56 | 131 |
| 1102626 | N/A | N/A | 31259 | 31278 | TGATTATTATTTTATGACAA | 75 | 132 |
| 1102628 | N/A | N/A | 31312 | 31331 | TATTTTTTACATTAACTAGA | 79 | 133 |

TABLE 1-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 % control | SEQ ID NO |
|---|---|---|---|---|---|---|---|
| 1102662 | N/A | N/A | 33021 | 33040 | TCTGAAATAAACATGGTGAA | 72 | 134 |
| 1102664 | N/A | N/A | 33385 | 33404 | TTATAGTTTCTCTATGATGT | 69 | 135 |
| 1102698 | N/A | N/A | 34137 | 34156 | AAGAAGTTAGTTCTTAACTC | 72 | 136 |
| 1102700 | N/A | N/A | 34168 | 34187 | TGAATGCAAGCCATTGTTAA | 52 | 137 |
| 1102734 | N/A | N/A | 34497 | 34516 | GCATGAAAACTATGATTACT | 18 | 138 |
| 1102736 | N/A | N/A | 34499 | 34518 | ATGCATGAAAACTATGATTA | 69 | 139 |
| 1102770 | N/A | N/A | 35322 | 35341 | TTATGTAAACCCCTAATTTC | 109 | 140 |
| 1102772 | N/A | N/A | 35438 | 35457 | TAATATCCTCATTACCCATT | 89 | 141 |
| 1102806 | N/A | N/A | 36969 | 36988 | TTAGCAAATCCTGATGCTGC | 72 | 142 |
| 1102808 | N/A | N/A | 36980 | 36999 | GTATCCTCCCATTAGCAAAT | 35 | 143 |
| 1102842 | N/A | N/A | 37709 | 37728 | TATTATTCCCAAATGGTTCA | 64 | 144 |
| 1102844 | N/A | N/A | 37730 | 37749 | TAATGGAAAATCATATCTGC | 56 | 145 |
| 1102878 | N/A | N/A | 38268 | 38287 | CCTTTGATCAGATAAAGCAT | 62 | 146 |
| 1102880 | N/A | N/A | 38289 | 38308 | GAAAGTCACCAAAAATAAGT | 75 | 147 |
| 1102914 | N/A | N/A | 38842 | 38861 | ACATTGTTTCACGAATCAAA | 65 | 148 |
| 1102916 | N/A | N/A | 38853 | 38872 | ATAAGGAAAATACATTGTTT | 111 | 149 |
| 1100537* | 1088 | 1107 | 45614 | 45633 | CATGGTCACAGCTGCCTGAA | 31 | 150 |
| 1100539* | 1090 | 1109 | 45616 | 45635 | GACATGGTCACAGCTGCCTG | 16 | 151 |
| 1102950* | N/A | N/A | 39345 | 39364 | TGAAGTTTAAATTATTATGT | 79 | 152 |
| 1102952* | N/A | N/A | 39361 | 39380 | ACTGTACAAATTACTGTGAA | 67 | 153 |
| 1102986* | N/A | N/A | 40095 | 40114 | TTATTTCTTCATTAAAGCCA | 50 | 154 |
| 1102988* | N/A | N/A | 40202 | 40221 | CAAAAAAATGCCAAACTGTT | 96 | 155 |
| 1103022* | N/A | N/A | 42830 | 42849 | GCTGTCATTCAAATTGCTTA | 60 | 156 |
| 1103024* | N/A | N/A | 42892 | 42911 | ACTAGAAAAATGTTGTATG | 74 | 157 |
| 1103058* | N/A | N/A | 44033 | 44052 | TAAAATAGTTTTCTAAATGT | 108 | 158 |
| 1103060* | N/A | N/A | 44071 | 44090 | AATATTAGCCAAAGAGGCAT | 106 | 159 |
| 1103094* | N/A | N/A | 45111 | 45130 | TGTAAAGATATTTAAGAGAG | 75 | 160 |
| 1103096* | N/A | N/A | 45130 | 45149 | CTGTCAATTCAAAGGAAGTT | 51 | 161 |

TABLE 2

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100358 | 16 | 35 | 3395 | 3414 | AACCACCCCTCCAGCTCCG | 85 | 162 |
| 1100360 | 18 | 37 | 3397 | 3416 | CGAACCACCCCTCCAGCTC | 111 | 163 |
| 1100361 | 19 | 38 | 3398 | 3417 | CCGAACCACCCCTCCAGCT | 103 | 164 |
| 1100362 | 44 | 63 | 3423 | 3442 | TTGTCTGGAGCCAACGGCCC | 64 | 165 |
| 1100363 | 56 | 75 | 3435 | 3454 | CTCCATGTTTATTTGTCTGG | 97 | 166 |
| 1100364 | 57 | 76 | 3436 | 3455 | ACTCCATGTTTATTTGTCTG | 86 | 167 |
| 1100365 | 63 | 82 | 3442 | 3461 | AGATGGACTCCATGTTTATT | 89 | 168 |
| 1100368 | 312 | 331 | 16178 | 16197 | CCCAAACTTTCAAGGCATTG | 79 | 169 |
| 1100369 | 313 | 332 | 16179 | 16198 | CCCCAAACTTTCAAGGCATT | 30 | 170 |
| 1100370 | 314 | 333 | 16180 | 16199 | ACCCCAAACTTTCAAGGCAT | 36 | 171 |
| 1100371 | 315 | 334 | 16181 | 16200 | AACCCCAAACTTTCAAGGCA | 50 | 172 |
| 1100372 | 316 | 335 | 16182 | 16201 | AAACCCCAAACTTTCAAGGC | 45 | 173 |
| 1100373 | 319 | 338 | 16185 | 16204 | TCTAAACCCCAAACTTTCAA | 57 | 174 |
| 1100374 | 320 | 339 | 16186 | 16205 | TTCTAAACCCCAAACTTTCA | 92 | 175 |
| 1100375 | 321 | 340 | 16187 | 16206 | GTTCTAAACCCCAAACTTTC | 48 | 176 |
| 1100376 | 322 | 341 | 16188 | 16207 | AGTTCTAAACCCCAAACTTT | 63 | 177 |
| 1100377 | 323 | 342 | 16189 | 16208 | TAGTTCTAAACCCCAAACTT | 81 | 178 |
| 1100378 | 324 | 343 | 16190 | 16209 | TTAGTTCTAAACCCCAAACT | 58 | 179 |
| 1100379 | 326 | 345 | 16192 | 16211 | GATTAGTTCTAAACCCCAAA | 15 | 180 |
| 1100380 | 327 | 346 | 16193 | 16212 | GGATTAGTTCTAAACCCCAA | 25 | 181 |
| 1100381 | 328 | 347 | 16194 | 16213 | AGGATTAGTTCTAAACCCCA | 23 | 182 |
| 1100382 | 330 | 349 | 16196 | 16215 | ACAGGATTAGTTCTAAACCC | 24 | 183 |
| 1100383 | 338 | 357 | 16204 | 16223 | ACTGTTGAACAGGATTAGTT | 64 | 184 |
| 1100384 | 356 | 375 | 16222 | 16241 | GAGCCTCTGATACTCTGGAC | 23 | 185 |
| 1100385 | 357 | 376 | 16223 | 16242 | TGAGCCTCTGATACTCTGGA | 51 | 186 |
| 1100386 | 359 | 378 | 16225 | 16244 | CCTGAGCCTCTGATACTCTG | 88 | 187 |
| 1100387 | 363 | 382 | 16229 | 16248 | CGATCCTGAGCCTCTGATAC | 41 | 188 |
| 1100388 | 368 | 387 | 16234 | 16253 | AGGATCGATCCTGAGCCTCT | 78 | 189 |
| 1100389 | 369 | 388 | 16235 | 16254 | TAGGATCGATCCTGAGCCTC | 91 | 190 |
| 1100390 | 371 | 390 | N/A | N/A | TATAGGATCGATCCTGAGCC | 60 | 191 |
| 1100391 | 372 | 391 | N/A | N/A | TTATAGGATCGATCCTGAGC | 71 | 192 |
| 1100392 | 381 | 400 | N/A | N/A | ATCTTTCATTTATAGGATCG | 59 | 193 |
| 1100394 | 384 | 403 | N/A | N/A | ATGATCTTTCATTTATAGGA | 92 | 194 |
| 1100396 | 391 | 410 | 16684 | 16703 | CATATAAATGATCTTTCATT | 79 | 195 |
| 1100397 | 392 | 411 | 16685 | 16704 | GCATATAAATGATCTTTCAT | 7 | 196 |
| 1100398 | 393 | 412 | 16686 | 16705 | TGCATATAAATGATCTTTCA | 12 | 197 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100399 | 394 | 413 | 16687 | 16706 | TTGCATATAAATGATCTTTC | 13 | 198 |
| 1100400 | 395 | 414 | 16688 | 16707 | ATTGCATATAAATGATCTTT | 31 | 199 |
| 1100401 | 397 | 416 | 16690 | 16709 | TAATTGCATATAAATGATCT | 68 | 200 |
| 1100402 | 403 | 422 | 16696 | 16715 | TCCTTATAATTGCATATAAA | 35 | 201 |
| 1100403 | 406 | 425 | 16699 | 16718 | TGTTCCTTATAATTGCATAT | 15 | 202 |
| 1100404 | 407 | 426 | 16700 | 16719 | GTGTTCCTTATAATTGCATA | 76 | 203 |
| 1100405 | 408 | 427 | 16701 | 16720 | AGTGTTCCTTATAATTGCAT | 7 | 204 |
| 1100406 | 409 | 428 | 16702 | 16721 | CAGTGTTCCTTATAATTGCA | 7 | 205 |
| 1100407 | 410 | 429 | 16703 | 16722 | CCAGTGTTCCTTATAATTGC | 10 | 206 |
| 1100408 | 411 | 430 | 16704 | 16723 | ACCAGTGTTCCTTATAATTG | 7 | 207 |
| 1100409 | 412 | 431 | 16705 | 16724 | AACCAGTGTTCCTTATAATT | 12 | 208 |
| 1100410 | 417 | 436 | 16710 | 16729 | CTGTAAACCAGTGTTCCTTA | 19 | 209 |
| 1100411 | 420 | 439 | 16713 | 16732 | TAACTGTAAACCAGTGTTCC | 80 | 210 |
| 1100412 | 421 | 440 | 16714 | 16733 | CTAACTGTAAACCAGTGTTC | 32 | 211 |
| 1100413 | 427 | 446 | 16720 | 16739 | AATTTTCTAACTGTAAACCA | 86 | 212 |
| 1100414 | 430 | 449 | 16723 | 16742 | CCTAATTTTCTAACTGTAAA | 79 | 213 |
| 1100415 | 431 | 450 | 16724 | 16743 | TCCTAATTTTCTAACTGTAA | 81 | 214 |
| 1100416 | 432 | 451 | 16725 | 16744 | TTCCTAATTTTCTAACTGTA | 71 | 215 |
| 1100417 | 433 | 452 | 16726 | 16745 | TTTCCTAATTTTCTAACTGT | 68 | 216 |
| 1100418 | 435 | 454 | 16728 | 16747 | GTTTTCCTAATTTTCTAACT | 75 | 217 |
| 1100419 | 438 | 457 | N/A | N/A | ACTGTTTTCCTAATTTTCTA | 56 | 218 |
| 1100420 | 440 | 459 | N/A | N/A | CCACTGTTTTCCTAATTTTC | 46 | 219 |
| 1100421 | 441 | 460 | N/A | N/A | ACCACTGTTTTCCTAATTTT | 38 | 220 |
| 1100422 | 442 | 461 | N/A | N/A | AACCACTGTTTTCCTAATTT | 48 | 221 |
| 1100423 | 447 | 466 | N/A | N/A | AGTTAAACCACTGTTTTCCT | 49 | 222 |
| 1100424 | 448 | 467 | N/A | N/A | AAGTTAAACCACTGTTTTCC | 58 | 223 |
| 1100425 | 450 | 469 | N/A | N/A | TCAAGTTAAACCACTGTTTT | 60 | 224 |
| 1100426 | 451 | 470 | N/A | N/A | TTCAAGTTAAACCACTGTTT | 60 | 225 |
| 1100427 | 453 | 472 | N/A | N/A | AATTCAAGTTAAACCACTGT | 66 | 226 |
| 1100428 | 456 | 475 | 21183 | 21202 | GAGAATTCAAGTTAAACCAC | 37 | 227 |
| 1100430 | 463 | 482 | 21190 | 21209 | GTCAAGAGAGAATTCAAGTT | 22 | 228 |
| 1100432 | 472 | 491 | 21199 | 21218 | TCTGGACCCGTCAAGAGAGA | 40 | 229 |
| 1100433 | 493 | 512 | 21220 | 21239 | AGATATGTATCTGATATTAA | 47 | 230 |
| 1100434 | 500 | 519 | 21227 | 21246 | AAGTGCAAGATATGTATCTG | 20 | 231 |
| 1100435 | 501 | 520 | 21228 | 21247 | AAAGTGCAAGATATGTATCT | 34 | 232 |
| 1100436 | 502 | 521 | 21229 | 21248 | AAAAGTGCAAGATATGTATC | 51 | 233 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100437 | 507 | 526 | 21234 | 21253 | CCAAGAAAAGTGCAAGATAT | 45 | 234 |
| 1100438 | 511 | 530 | 21238 | 21257 | TGAGCCAAGAAAAGTGCAAG | 77 | 235 |
| 1100439 | 512 | 531 | 21239 | 21258 | TTGAGCCAAGAAAAGTGCAA | 78 | 236 |
| 1100440 | 515 | 534 | 21242 | 21261 | TAATTGAGCCAAGAAAAGTG | 75 | 237 |
| 1100441 | 517 | 536 | 21244 | 21263 | TGTAATTGAGCCAAGAAAAG | 77 | 238 |
| 1100442 | 522 | 541 | 21249 | 21268 | CCTGTTGTAATTGAGCCAAG | 42 | 239 |
| 1100443 | 531 | 550 | N/A | N/A | AATAACCTTCCTGTTGTAAT | 61 | 240 |
| 1100444 | 532 | 551 | N/A | N/A | GAATAACCTTCCTGTTGTAA | 54 | 241 |
| 1100445 | 533 | 552 | N/A | N/A | AGAATAACCTTCCTGTTGTA | 47 | 242 |
| 1100446 | 534 | 553 | N/A | N/A | TAGAATAACCTTCCTGTTGT | 51 | 243 |
| 1100447 | 535 | 554 | N/A | N/A | ATAGAATAACCTTCCTGTTG | 62 | 244 |
| 1100448 | 536 | 555 | N/A | N/A | TATAGAATAACCTTCCTGTT | 64 | 245 |
| 1100449 | 537 | 556 | N/A | N/A | ATATAGAATAACCTTCCTGT | 80 | 246 |
| 1100450 | 539 | 558 | N/A | N/A | AAATATAGAATAACCTTCCT | 73 | 247 |
| 1100451 | 540 | 559 | N/A | N/A | CAAATATAGAATAACCTTCC | 73 | 248 |
| 1100452 | 541 | 560 | N/A | N/A | ACAAATATAGAATAACCTTC | 76 | 249 |
| 1100453 | 546 | 565 | 26744 | 26763 | TAACGACAAATATAGAATAA | 93 | 250 |
| 1100454 | 558 | 577 | 26756 | 26775 | GCAGATCACCCTTAACGACA | 26 | 251 |
| 1100455 | 561 | 580 | 26759 | 26778 | CTGGCAGATCACCCTTAACG | 35 | 252 |
| 1100456 | 563 | 582 | 26761 | 26780 | ATCTGGCAGATCACCCTTAA | 54 | 253 |
| 1100457 | 564 | 583 | 26762 | 26781 | AATCTGGCAGATCACCCTTA | 75 | 254 |
| 1100458 | 565 | 584 | 26763 | 26782 | CAATCTGGCAGATCACCCTT | 49 | 255 |
| 1100459 | 566 | 585 | 26764 | 26783 | GCAATCTGGCAGATCACCCT | 48 | 256 |
| 1100460 | 567 | 586 | 26765 | 26784 | CGCAATCTGGCAGATCACCC | 60 | 257 |
| 1100461 | 568 | 587 | 26766 | 26785 | TCGCAATCTGGCAGATCACC | 48 | 258 |
| 1100462 | 569 | 588 | 26767 | 26786 | TTCGCAATCTGGCAGATCAC | 87 | 259 |
| 1100463 | 571 | 590 | 26769 | 26788 | GCTTCGCAATCTGGCAGATC | 67 | 260 |
| 1100464 | 635 | 654 | 26833 | 26852 | TTCTTCTCCAATAAGTTTTG | 81 | 261 |
| 1100466 | 639 | 658 | 26837 | 26856 | CTAATTCTTCTCCAATAAGT | 96 | 262 |
| 1100468 | 642 | 661 | 26840 | 26859 | GTGCTAATTCTTCTCCAATA | 23 | 263 |
| 1100469 | 644 | 663 | 26842 | 26861 | TTGTGCTAATTCTTCTCCAA | 72 | 264 |
| 1100470 | 645 | 664 | 26843 | 26862 | GTTGTGCTAATTCTTCTCCA | 34 | 265 |
| 1100471 | 675 | 694 | N/A | N/A | GGTCTGTTTTATGGACTCTT | 60 | 266 |
| 1100472 | 677 | 696 | 27534 | 27553 | CAGGTCTGTTTTATGGACTC | 86 | 267 |
| 1100473 | 678 | 697 | 27535 | 27554 | CCAGGTCTGTTTTATGGACT | 69 | 268 |
| 1100474 | 700 | 719 | 27557 | 27576 | TCATTTGCTTCTAACACTCG | 87 | 269 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100475 | 705 | 724 | 27562 | 27581 | AGCCATCATTTGCTTCTAAC | 19 | 270 |
| 1100476 | 711 | 730 | 27568 | 27587 | TTCCTGAGCCATCATTTGCT | 80 | 271 |
| 1100477 | 712 | 731 | 27569 | 27588 | ATTCCTGAGCCATCATTTGC | 52 | 272 |
| 1100478 | 713 | 732 | 27570 | 27589 | CATTCCTGAGCCATCATTTG | 56 | 273 |
| 1100479 | 718 | 737 | 27575 | 27594 | TCTAACATTCCTGAGCCATC | 18 | 274 |
| 1100480 | 739 | 758 | 27596 | 27615 | TGCAAATCCTCCTCATCTTC | 42 | 275 |
| 1100481 | 740 | 759 | 27597 | 27616 | CTGCAAATCCTCCTCATCTT | 53 | 276 |
| 1100482 | 741 | 760 | 27598 | 27617 | TCTGCAAATCCTCCTCATCT | 53 | 277 |
| 1100483 | 742 | 761 | 27599 | 27618 | CTCTGCAAATCCTCCTCATC | 64 | 278 |
| 1100484 | 743 | 762 | 27600 | 27619 | CCTCTGCAAATCCTCCTCAT | 46 | 279 |
| 1100485 | 745 | 764 | 27602 | 27621 | GCCCTCTGCAAATCCTCCTC | 58 | 280 |
| 1100486 | 752 | 771 | 27609 | 27628 | TGCCAGAGCCCTCTGCAAAT | 68 | 281 |
| 1100487 | 754 | 773 | 27611 | 27630 | AGTGCCAGAGCCCTCTGCAA | 64 | 282 |
| 1100488 | 760 | 779 | 27617 | 27636 | CGACTTAGTGCCAGAGCCCT | 86 | 283 |
| 1100489 | 762 | 781 | 27619 | 27638 | GGCGACTTAGTGCCAGAGCC | 83 | 284 |
| 1100490 | 767 | 786 | 27624 | 27643 | TTCTTGGCGACTTAGTGCCA | 59 | 285 |
| 1100491 | 776 | 795 | 27633 | 27652 | CATGTCAATTTCTTGGCGAC | 83 | 286 |
| 1100492 | 777 | 796 | 27634 | 27653 | CCATGTCAATTTCTTGGCGA | 72 | 287 |
| 1100493 | 786 | 805 | 27643 | 27662 | CCTCATCTTCCATGTCAATT | 66 | 288 |
| 1100494 | 788 | 807 | 27645 | 27664 | TTCCTCATCTTCCATGTCAA | 52 | 289 |
| 1100495 | 789 | 808 | 27646 | 27665 | CTTCCTCATCTTCCATGTCA | 47 | 290 |
| 1100496 | 792 | 811 | 27649 | 27668 | CTGCTTCCTCATCTTCCATG | 28 | 291 |
| 1100497 | 793 | 812 | 27650 | 27669 | TCTGCTTCCTCATCTTCCAT | 33 | 292 |
| 1100498 | 794 | 813 | 27651 | 27670 | ATCTGCTTCCTCATCTTCCA | 37 | 293 |
| 1100499 | 795 | 814 | 27652 | 27671 | GATCTGCTTCCTCATCTTCC | 43 | 294 |
| 1100500 | 796 | 815 | 27653 | 27672 | AGATCTGCTTCCTCATCTTC | 45 | 295 |
| 1100502 | 814 | 833 | 27671 | 27690 | AGCTGAATAGCCCTGCGGAG | 68 | 296 |
| 1100504 | 827 | 846 | 27684 | 27703 | ACCTTGCATACTTAGCTGAA | 77 | 297 |
| 1100505 | 833 | 852 | N/A | N/A | GGAACTACCTTGCATACTTA | 20 | 298 |
| 1100506 | 836 | 855 | N/A | N/A | TCTGGAACTACCTTGCATAC | 47 | 299 |
| 1100507 | 838 | 857 | N/A | N/A | TTTCTGGAACTACCTTGCAT | 69 | 300 |
| 1100508 | 875 | 894 | 28970 | 28989 | ATTTGTACCTGATGTCTGTG | 30 | 301 |
| 1100509 | 877 | 896 | 28972 | 28991 | AGATTTGTACCTGATGTCTG | 50 | 302 |
| 1100510 | 883 | 902 | 28978 | 28997 | GAAGTAAGATTTGTACCTGA | 41 | 303 |
| 1100511 | 885 | 904 | 28980 | 28999 | CTGAAGTAAGATTTGTACCT | 91 | 304 |
| 1100512 | 886 | 905 | 28981 | 29000 | TCTGAAGTAAGATTTGTACC | 91 | 305 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100513 | 904 | 923 | 28999 | 29018 | CGTCTCTTCCGAAGCTCTTC | 69 | 306 |
| 1100514 | 926 | 945 | N/A | N/A | CTGTTTTTCAAAGTAGGCTT | 41 | 307 |
| 1100515 | 927 | 946 | N/A | N/A | GCTGTTTTTCAAAGTAGGCT | 67 | 308 |
| 1100516 | 928 | 947 | N/A | N/A | TGCTGTTTTTCAAAGTAGGC | 43 | 309 |
| 1100517 | 929 | 948 | N/A | N/A | CTGCTGTTTTTCAAAGTAGG | 81 | 310 |
| 1100518 | 930 | 949 | N/A | N/A | GCTGCTGTTTTTCAAAGTAG | 65 | 311 |
| 1100519 | 931 | 950 | N/A | N/A | TGCTGCTGTTTTTCAAAGTA | 44 | 312 |
| 1100557 | 1120 | 1139 | 45646 | 45665 | GTTTTCAAATCATTTCTGAC | 19 | 313 |
| 1100558 | 1121 | 1140 | 45647 | 45666 | TGTTTTCAAATCATTTCTGA | 40 | 314 |
| 1100559 | 1122 | 1141 | 45648 | 45667 | CTGTTTTCAAATCATTTCTG | 12 | 315 |
| 1100560 | 1126 | 1145 | 45652 | 45671 | CCTTCTGTTTTCAAATCATT | 20 | 316 |
| 1100561 | 1127 | 1146 | 45653 | 45672 | TCCTTCTGTTTTCAAATCAT | 20 | 317 |
| 1100562 | 1143 | 1162 | 45669 | 45688 | AAAGGTATTATTTTTTCCT | 39 | 318 |
| 1100563 | 1144 | 1163 | 45670 | 45689 | TAAAGGTATTATTTTTTCC | 29 | 319 |
| 1100564 | 1145 | 1164 | 45671 | 45690 | TTAAAGGTATTATTTTTTC | 122 | 320 |
| 1100565 | 1167 | 1186 | 45693 | 45712 | GTATGAATATCTAAATTATT | 80 | 321 |
| 1100566 | 1172 | 1191 | 45698 | 45717 | GGAAAGTATGAATATCTAAA | 3 | 322 |
| 1100567 | 1176 | 1195 | 45702 | 45721 | TGTTGGAAAGTATGAATATC | 19 | 323 |
| 1100568 | 1209 | 1228 | 45735 | 45754 | AAGTGGACCCTATGCTGTAA | 20 | 324 |
| 1100569 | 1210 | 1229 | 45736 | 45755 | AAAGTGGACCCTATGCTGTA | 50 | 325 |
| 1100570 | 1211 | 1230 | 45737 | 45756 | CAAAGTGGACCCTATGCTGT | 85 | 326 |
| 1100571 | 1220 | 1239 | 45746 | 45765 | ACACATTACCAAAGTGGACC | 14 | 327 |
| 1100572 | 1221 | 1240 | 45747 | 45766 | GACACATTACCAAAGTGGAC | 13 | 328 |
| 1100574 | 1223 | 1242 | 45749 | 45768 | TTGACACATTACCAAAGTGG | 25 | 329 |
| 1100576 | 1226 | 1245 | 45752 | 45771 | TCTTTGACACATTACCAAAG | 64 | 330 |
| 1100577 | 1227 | 1246 | 45753 | 45772 | CTCTTTGACACATTACCAAA | 35 | 331 |
| 1100578 | 1228 | 1247 | 45754 | 45773 | TCTCTTTGACACATTACCAA | 54 | 332 |
| 1100579 | 1230 | 1249 | 45756 | 45775 | CATCTCTTTGACACATTACC | 34 | 333 |
| 1100580 | 1232 | 1251 | 45758 | 45777 | CTCATCTCTTTGACACATTA | 16 | 334 |
| 1100581 | 1235 | 1254 | 45761 | 45780 | TTCCTCATCTCTTTGACACA | 33 | 335 |
| 1100582 | 1240 | 1259 | 45766 | 45785 | CTTATTTCCTCATCTCTTTG | 33 | 336 |
| 1100583 | 1243 | 1262 | 45769 | 45788 | AGTCTTATTTCCTCATCTCT | 17 | 337 |
| 1100584 | 1244 | 1263 | 45770 | 45789 | AAGTCTTATTTCCTCATCTC | 81 | 338 |
| 1100585 | 1245 | 1264 | 45771 | 45790 | AAAGTCTTATTTCCTCATCT | 10 | 339 |
| 1100586 | 1246 | 1265 | 45772 | 45791 | AAAAGTCTTATTTCCTCATC | 31 | 340 |
| 1100587 | 1307 | 1326 | 45833 | 45852 | TTATTTAGTCCTACAACCGA | 62 | 341 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100588 | 1311 | 1330 | 45837 | 45856 | ATCATTATTTAGTCCTACAA | 30 | 342 |
| 1100589 | 1314 | 1333 | 45840 | 45859 | AAGATCATTATTTAGTCCTA | 17 | 343 |
| 1100590 | 1317 | 1336 | 45843 | 45862 | TGGAAGATCATTATTTAGTC | 6 | 344 |
| 1100591 | 1318 | 1337 | 45844 | 45863 | TTGGAAGATCATTATTTAGT | 11 | 345 |
| 1100592 | 1319 | 1338 | 45845 | 45864 | TTTGGAAGATCATTATTTAG | 23 | 346 |
| 1100593 | 1321 | 1340 | 45847 | 45866 | TATTTGGAAGATCATTATTT | 66 | 347 |
| 1100594 | 1322 | 1341 | 45848 | 45867 | ATATTTGGAAGATCATTATT | 84 | 348 |
| 1100595 | 1331 | 1350 | 45857 | 45876 | CTTTGGCTAATATTTGGAAG | 37 | 349 |
| 1100596 | 1332 | 1351 | 45858 | 45877 | TCTTTGGCTAATATTTGGAA | 43 | 350 |
| 1100597 | 1333 | 1352 | 45859 | 45878 | CTCTTTGGCTAATATTTGGA | 12 | 351 |
| 1100598 | 1344 | 1363 | 45870 | 45889 | TTGCTGAATGCCTCTTTGGC | 33 | 352 |
| 1100599 | 1400 | 1419 | 45926 | 45945 | TTGCACACTCAAAAAGAAA | 72 | 353 |
| 1100600 | 1402 | 1421 | 45928 | 45947 | TATTGCACACTCAAAAAGA | 105 | 354 |
| 1100601 | 1403 | 1422 | 45929 | 45948 | ATATTGCACACTCAAAAAG | 70 | 355 |
| 1100602 | 1441 | 1460 | 45967 | 45986 | AAGATCCAAGAAAATGCCC | 78 | 356 |
| 1100603 | 1447 | 1466 | 45973 | 45992 | TGCAAAAAGATCCAAGAAAA | 105 | 357 |
| 1100604 | 1448 | 1467 | 45974 | 45993 | CTGCAAAAAGATCCAAGAAA | 65 | 358 |
| 1100605 | 1449 | 1468 | 45975 | 45994 | TCTGCAAAAAGATCCAAGAA | 68 | 359 |
| 1100606 | 1498 | 1517 | 46024 | 46043 | AGAAAACAAACTATATGGAA | 87 | 360 |
| 1100607 | 1550 | 1569 | 46076 | 46095 | AATGAAAGCCACTATTACAT | 74 | 361 |
| 1100608 | 1552 | 1571 | 46078 | 46097 | GAAATGAAAGCCACTATTAC | 59 | 362 |
| 1100610 | 1565 | 1584 | 46091 | 46110 | ATTTGGTTAATAAGAAATGA | 103 | 363 |
| 1100612 | 1567 | 1586 | 46093 | 46112 | TAATTTGGTTAATAAGAAAT | 87 | 364 |
| 1100613 | 1575 | 1594 | 46101 | 46120 | TGAAAGGTTAATTTGGTTAA | 93 | 365 |
| 1100614 | 1576 | 1595 | 46102 | 46121 | CTGAAAGGTTAATTTGGTTA | 70 | 366 |
| 1100615 | 1583 | 1602 | 46109 | 46128 | TACTTTCCTGAAAGGTTAAT | 109 | 367 |
| 1100616 | 1586 | 1605 | 46112 | 46131 | AGATACTTTCCTGAAAGGTT | 72 | 368 |
| 1100617 | 1587 | 1606 | 46113 | 46132 | GAGATACTTTCCTGAAAGGT | 97 | 369 |
| 1100618 | 1588 | 1607 | 46114 | 46133 | AGAGATACTTTCCTGAAAGG | 107 | 370 |
| 1100619 | 1611 | 1630 | 46137 | 46156 | ACTATTATCAACATCAGGAA | 90 | 371 |
| 1100620 | 1619 | 1638 | 46145 | 46164 | GAACCATTACTATTATCAAC | 120 | 372 |
| 1100621 | 1620 | 1639 | 46146 | 46165 | AGAACCATTACTATTATCAA | 31 | 373 |
| 1100622 | 1621 | 1640 | 46147 | 46166 | TAGAACCATTACTATTATCA | 31 | 374 |
| 1100623 | 1623 | 1642 | 46149 | 46168 | TCTAGAACCATTACTATTAT | 81 | 375 |
| 1100624 | 1624 | 1643 | 46150 | 46169 | TTCTAGAACCATTACTATTA | 60 | 376 |
| 1100625 | 1625 | 1644 | 46151 | 46170 | CTTCTAGAACCATTACTATT | 78 | 377 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100626 | 1626 | 1645 | 46152 | 46171 | CCTTCTAGAACCATTACTAT | 46 | 378 |
| 1100627 | 1627 | 1646 | 46153 | 46172 | TCCTTCTAGAACCATTACTA | 60 | 379 |
| 1100628 | 1679 | 1698 | 46205 | 46224 | ACACAAGAAAACACTGGAGC | 36 | 380 |
| 1100629 | 1681 | 1700 | 46207 | 46226 | CAACACAAGAAAACACTGGA | 72 | 381 |
| 1100630 | 1691 | 1710 | 46217 | 46236 | TCAGAGAAAACAACACAAGA | 70 | 382 |
| 1100631 | 1721 | 1740 | 46247 | 46266 | AATGAAAACCAGGTAGCAGA | 64 | 383 |
| 1100632 | 1723 | 1742 | 46249 | 46268 | ATAATGAAAACCAGGTAGCA | 77 | 384 |
| 1100633 | 1727 | 1746 | 46253 | 46272 | GAAAATAATGAAAACCAGGT | 63 | 385 |
| 1100634 | 1731 | 1750 | 46257 | 46276 | GTGGGAAAATAATGAAAACC | 35 | 386 |
| 1100635 | 1732 | 1751 | 46258 | 46277 | TGTGGGAAAATAATGAAAAC | 73 | 387 |
| 1100636 | 1733 | 1752 | 46259 | 46278 | TTGTGGGAAAATAATGAAAA | 71 | 388 |
| 1100637 | 1743 | 1762 | 46269 | 46288 | TTCAAAAGAATTGTGGGAAA | 81 | 389 |
| 1100638 | 1745 | 1764 | 46271 | 46290 | CTTTCAAAAGAATTGTGGGA | 44 | 390 |
| 1100639 | 1746 | 1765 | 46272 | 46291 | TCTTTCAAAAGAATTGTGGG | 42 | 391 |
| 1100640 | 1748 | 1767 | 46274 | 46293 | CATCTTTCAAAAGAATTGTG | 66 | 392 |
| 1100641 | 1749 | 1768 | 46275 | 46294 | CCATCTTTCAAAAGAATTGT | 26 | 393 |
| 1100642 | 1750 | 1769 | 46276 | 46295 | ACCATCTTTCAAAAGAATTG | 52 | 394 |
| 1100643 | 1754 | 1773 | 46280 | 46299 | GATTACCATCTTTCAAAAGA | 44 | 395 |
| 1100644 | 1757 | 1776 | 46283 | 46302 | AAAGATTACCATCTTTCAAA | 96 | 396 |
| 1100646 | 1759 | 1778 | 46285 | 46304 | GAAAGATTACCATCTTTCA | 39 | 397 |
| 1100648 | 1761 | 1780 | 46287 | 46306 | CAGAAAAGATTACCATCTTT | 91 | 398 |
| 1100649 | 1762 | 1781 | 46288 | 46307 | TCAGAAAAGATTACCATCTT | 66 | 399 |
| 1100650 | 1763 | 1782 | 46289 | 46308 | CTCAGAAAAGATTACCATCT | 67 | 400 |
| 1100651 | 1764 | 1783 | 46290 | 46309 | CCTCAGAAAAGATTACCATC | 62 | 401 |
| 1100652 | 1772 | 1791 | 46298 | 46317 | ACGCTAAACCTCAGAAAAGA | 67 | 402 |
| 1100653 | 1804 | 1823 | 46330 | 46349 | CATGAAATAATGATCCCATC | 98 | 403 |
| 1100654 | 1805 | 1824 | 46331 | 46350 | TCATGAAATAATGATCCCAT | 60 | 404 |
| 1100655 | 1806 | 1825 | 46332 | 46351 | GTCATGAAATAATGATCCCA | 44 | 405 |
| 1100656 | 1807 | 1826 | 46333 | 46352 | AGTCATGAAATAATGATCCC | 94 | 406 |
| 1100657 | 1808 | 1827 | 46334 | 46353 | CAGTCATGAAATAATGATCC | 68 | 407 |
| 1100658 | 1809 | 1828 | 46335 | 46354 | CCAGTCATGAAATAATGATC | 54 | 408 |
| 1100659 | 1810 | 1829 | 46336 | 46355 | ACCAGTCATGAAATAATGAT | 80 | 409 |
| 1100660 | 1819 | 1838 | 46345 | 46364 | TAGGAACGCACCAGTCATGA | 38 | 410 |
| 1100661 | 1821 | 1840 | 46347 | 46366 | TTTAGGAACGCACCAGTCAT | 50 | 411 |
| 1100662 | 1822 | 1841 | 46348 | 46367 | GTTTAGGAACGCACCAGTCA | 55 | 412 |
| 1100663 | 1823 | 1842 | 46349 | 46368 | AGTTTAGGAACGCACCAGTC | 35 | 413 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100664 | 1824 | 1843 | 46350 | 46369 | GAGTTTAGGAACGCACCAGT | 31 | 414 |
| 1100665 | 1825 | 1844 | 46351 | 46370 | AGAGTTTAGGAACGCACCAG | 22 | 415 |
| 1100666 | 1826 | 1845 | 46352 | 46371 | CAGAGTTTAGGAACGCACCA | 16 | 416 |
| 1100667 | 1827 | 1846 | 46353 | 46372 | TCAGAGTTTAGGAACGCACC | 13 | 417 |
| 1100668 | 1829 | 1848 | 46355 | 46374 | TTTCAGAGTTTAGGAACGCA | 16 | 418 |
| 1100669 | 1835 | 1854 | 46361 | 46380 | GGCTGATTTCAGAGTTTAGG | 12 | 419 |
| 1100670 | 1860 | 1879 | 46386 | 46405 | CATTTATTCTCAAGTACTTG | 25 | 420 |
| 1100671 | 1861 | 1880 | 46387 | 46406 | TCATTTATTCTCAAGTACTT | 40 | 421 |
| 1100672 | 1862 | 1881 | 46388 | 46407 | CTCATTTATTCTCAAGTACT | 31 | 422 |
| 1100673 | 1863 | 1882 | 46389 | 46408 | GCTCATTTATTCTCAAGTAC | 12 | 423 |
| 1100674 | 1868 | 1887 | 46394 | 46413 | AAAATGCTCATTTATTCTCA | 49 | 424 |
| 1100675 | 1889 | 1908 | 46415 | 46434 | GCACATGCTCACACATTTTA | 43 | 425 |
| 1100676 | 1927 | 1946 | 46453 | 46472 | GATATAAGTGAAAAGACATT | 80 | 426 |
| 1100677 | 1953 | 1972 | 46479 | 46498 | GGGTTGCAACAAAGCTGTAA | 40 | 427 |
| 1100678 | 1980 | 1999 | 46506 | 46525 | AAGGAAAAAATAAGGCGCAG | 71 | 428 |
| 1100679 | 1982 | 2001 | 46508 | 46527 | GAAAGGAAAAAATAAGGCGC | 97 | 429 |
| 1100680 | 2004 | 2023 | 46530 | 46549 | CCTAGTTTTCTCAATTGGAG | 98 | 430 |
| 1100682 | 2006 | 2025 | 46532 | 46551 | CTCCTAGTTTTCTCAATTGG | 53 | 431 |
| 1100684 | 2009 | 2028 | 46535 | 46554 | CTTCTCCTAGTTTTCTCAAT | 45 | 432 |
| 1100685 | 2014 | 2033 | 46540 | 46559 | CTATGCTTCTCCTAGTTTTC | 50 | 433 |
| 1100686 | 2015 | 2034 | 46541 | 46560 | ACTATGCTTCTCCTAGTTTT | 61 | 434 |
| 1100687 | 2023 | 2042 | 46549 | 46568 | GCCTGCATACTATGCTTCTC | 68 | 435 |
| 1100688 | 2024 | 2043 | 46550 | 46569 | TGCCTGCATACTATGCTTCT | 92 | 436 |
| 1100689 | 2030 | 2049 | 46556 | 46575 | GAGACTTGCCTGCATACTAT | 33 | 437 |
| 1100690 | 2045 | 2064 | 46571 | 46590 | GTCTTCTAACAGAAGGAGAC | 125 | 438 |
| 1100691 | 2046 | 2065 | 46572 | 46591 | AGTCTTCTAACAGAAGGAGA | 137 | 439 |
| 1100692 | 2047 | 2066 | 46573 | 46592 | TAGTCTTCTAACAGAAGGAG | 72 | 440 |
| 1100693 | 2048 | 2067 | 46574 | 46593 | TTAGTCTTCTAACAGAAGGA | 81 | 441 |
| 1100694 | 2049 | 2068 | 46575 | 46594 | TTTAGTCTTCTAACAGAAGG | 85 | 442 |
| 1100695 | 2050 | 2069 | 46576 | 46595 | GTTTAGTCTTCTAACAGAAG | 42 | 443 |
| 1100696 | 2052 | 2071 | 46578 | 46597 | ATGTTTAGTCTTCTAACAGA | 43 | 444 |
| 1100697 | 2054 | 2073 | 46580 | 46599 | GTATGTTTAGTCTTCTAACA | 19 | 445 |
| 1100698 | 2091 | 2110 | 46617 | 46636 | GGCCAAATTTCATGTATCAT | 35 | 446 |
| 1100699 | 2093 | 2112 | 46619 | 46638 | AAGGCCAAATTTCATGTATC | 48 | 447 |
| 1100700 | 2094 | 2113 | 46620 | 46639 | GAAGGCCAAATTTCATGTAT | 34 | 448 |
| 1100701 | 2097 | 2116 | 46623 | 46642 | ATTGAAGGCCAAATTTCATG | 48 | 449 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100702 | 2105 | 2124 | 46631 | 46650 | CTATTAAAATTGAAGGCCAA | 77 | 450 |
| 1100703 | 2106 | 2125 | 46632 | 46651 | GCTATTAAAATTGAAGGCCA | 48 | 451 |
| 1100704 | 2108 | 2127 | 46634 | 46653 | CTGCTATTAAAATTGAAGGC | 25 | 452 |
| 1100705 | 2109 | 2128 | 46635 | 46654 | ACTGCTATTAAAATTGAAGG | 35 | 453 |
| 1100706 | 2110 | 2129 | 46636 | 46655 | AACTGCTATTAAAATTGAAG | 71 | 454 |
| 1100707 | 2111 | 2130 | 46637 | 46656 | AAACTGCTATTAAAATTGAA | 78 | 455 |
| 1100708 | 2112 | 2131 | 46638 | 46657 | AAAACTGCTATTAAAATTGA | 111 | 456 |
| 1100709 | 2168 | 2187 | 46694 | 46713 | CATGACTCAACTGTAAAGAG | 29 | 457 |
| 1100710 | 2204 | 2223 | 46730 | 46749 | TACCTACTAAAAGATGTGAA | 85 | 458 |
| 1100711 | 2205 | 2224 | 46731 | 46750 | ATACCTACTAAAAGATGTGA | 74 | 459 |
| 1100712 | 2206 | 2225 | 46732 | 46751 | TATACCTACTAAAAGATGTG | 77 | 460 |
| 1100713 | 2207 | 2226 | 46733 | 46752 | CTATACCTACTAAAAGATGT | 103 | 461 |
| 1100714 | 2208 | 2227 | 46734 | 46753 | GCTATACCTACTAAAAGATG | 55 | 462 |
| 1100715 | 2209 | 2228 | 46735 | 46754 | AGCTATACCTACTAAAAGAT | 63 | 463 |
| 1100716 | 2210 | 2229 | 46736 | 46755 | AAGCTATACCTACTAAAAGA | 73 | 464 |
| 1100718 | 2212 | 2231 | 46738 | 46757 | ACAAGCTATACCTACTAAAA | 60 | 465 |
| 1100720 | 2214 | 2233 | 46740 | 46759 | TGACAAGCTATACCTACTAA | 45 | 466 |
| 1100721 | 2216 | 2235 | 46742 | 46761 | TTTGACAAGCTATACCTACT | 57 | 467 |
| 1100722 | 2225 | 2244 | 46751 | 46770 | ATCACCATCTTTGACAAGCT | 30 | 468 |
| 1100723 | 2229 | 2248 | 46755 | 46774 | CCAGATCACCATCTTTGACA | 22 | 469 |
| 1100724 | 2231 | 2250 | 46757 | 46776 | TTCCAGATCACCATCTTTGA | 38 | 470 |
| 1100725 | 2232 | 2251 | 46758 | 46777 | GTTCCAGATCACCATCTTTG | 8 | 471 |
| 1100726 | 2233 | 2252 | 46759 | 46778 | TGTTCCAGATCACCATCTTT | 39 | 472 |
| 1100727 | 2234 | 2253 | 46760 | 46779 | ATGTTCCAGATCACCATCTT | 38 | 473 |
| 1100728 | 2236 | 2255 | 46762 | 46781 | TCATGTTCCAGATCACCATC | 83 | 474 |
| 1100729 | 2237 | 2256 | 46763 | 46782 | TTCATGTTCCAGATCACCAT | 16 | 475 |
| 1100730 | 2238 | 2257 | 46764 | 46783 | TTTCATGTTCCAGATCACCA | 15 | 476 |
| 1100731 | 2239 | 2258 | 46765 | 46784 | TTTTCATGTTCCAGATCACC | 22 | 477 |
| 1100732 | 2244 | 2263 | 46770 | 46789 | AATTATTTTCATGTTCCAGA | 12 | 478 |
| 1100733 | 2251 | 2270 | 46777 | 46796 | ATTAGTAAATTATTTTCATG | 76 | 479 |
| 1100734 | 2261 | 2280 | 46787 | 46806 | ACATATTTTCATTAGTAAAT | 131 | 480 |
| 1100735 | 2262 | 2281 | 46788 | 46807 | AACATATTTTCATTAGTAAA | 82 | 481 |
| 1100736 | 2273 | 2292 | 46799 | 46818 | GTATAAATTTAAACATATTT | 82 | 482 |
| 1100737 | 2276 | 2295 | 46802 | 46821 | ACAGTATAAATTTAAACATA | 101 | 483 |
| 1100738 | 2277 | 2296 | 46803 | 46822 | CACAGTATAAATTTAAACAT | 86 | 484 |
| 1100739 | 2278 | 2297 | 46804 | 46823 | TCACAGTATAAATTTAAACA | 96 | 485 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100740 | 2279 | 2298 | 46805 | 46824 | ATCACAGTATAAATTTAAAC | 116 | 486 |
| 1100741 | 2280 | 2299 | 46806 | 46825 | AATCACAGTATAAATTTAAA | 79 | 487 |
| 1100742 | 2282 | 2301 | 46808 | 46827 | CAAATCACAGTATAAATTTA | 92 | 488 |
| 1100743 | 2288 | 2307 | 46814 | 46833 | AAGTGTCAAATCACAGTATA | 58 | 489 |
| 1100744 | 2291 | 2310 | 46817 | 46836 | TGCAAGTGTCAAATCACAGT | 28 | 490 |
| 1100745 | 2305 | 2324 | 46831 | 46850 | CTATCTAAACATGATGCAAG | 63 | 491 |
| 1100746 | 2306 | 2325 | 46832 | 46851 | GCTATCTAAACATGATGCAA | 62 | 492 |
| 1100747 | 2307 | 2326 | 46833 | 46852 | AGCTATCTAAACATGATGCA | 87 | 493 |
| 1100748 | 2309 | 2328 | 46835 | 46854 | TAAGCTATCTAAACATGATG | 77 | 494 |
| 1100749 | 2310 | 2329 | 46836 | 46855 | TTAAGCTATCTAAACATGAT | 89 | 495 |
| 1100750 | 2311 | 2330 | 46837 | 46856 | CTTAAGCTATCTAAACATGA | 81 | 496 |
| 1100751 | 2312 | 2331 | 46838 | 46857 | TCTTAAGCTATCTAAACATG | 52 | 497 |
| 1100752 | 2314 | 2333 | 46840 | 46859 | GTTCTTAAGCTATCTAAACA | 63 | 498 |
| 1100754 | 2346 | 2365 | 46872 | 46891 | TTATAGATCCACTAAGTACT | 71 | 499 |
| 1100756 | 2355 | 2374 | 46881 | 46900 | CTTTCTTATTTATAGATCCA | 22 | 500 |
| 1100757 | 2357 | 2376 | 46883 | 46902 | GACTTTCTTATTTATAGATC | 32 | 501 |
| 1100758 | 2371 | 2390 | 46897 | 46916 | TTATCAAAACTATGGACTTT | 89 | 502 |
| 1100759 | 2372 | 2391 | 46898 | 46917 | TTTATCAAAACTATGGACTT | 61 | 503 |
| 1100760 | 2373 | 2392 | 46899 | 46918 | ATTTATCAAAACTATGGACT | 56 | 504 |
| 1100761 | 2375 | 2394 | 46901 | 46920 | ATATTTATCAAAACTATGGA | 87 | 505 |
| 1100762 | 2376 | 2395 | 46902 | 46921 | AATATTTATCAAAACTATGG | 75 | 506 |
| 1100763 | 2384 | 2403 | 46910 | 46929 | TTAAAGAGAATATTTATCAA | 123 | 507 |
| 1100764 | 2386 | 2405 | 46912 | 46931 | AATTAAAGAGAATATTTATC | 107 | 508 |
| 1100765 | 2392 | 2411 | 46918 | 46937 | CATCTCAATTAAAGAGAATA | 172 | 509 |
| 1100766 | 2395 | 2414 | 46921 | 46940 | GTACATCTCAATTAAAGAGA | 36 | 510 |
| 1100767 | 2422 | 2441 | 46948 | 46967 | TCCTATTGACCCAGCAAGAA | 38 | 511 |
| 1100768 | 2426 | 2445 | 46952 | 46971 | ACTATCCTATTGACCCAGCA | 24 | 512 |
| 1100769 | 2430 | 2449 | 46956 | 46975 | TGATACTATCCTATTGACCC | 25 | 513 |
| 1100770 | 2444 | 2463 | 46970 | 46989 | GGTTTTCACCAAAATGATAC | 50 | 514 |
| 1100771 | 2463 | 2482 | 46989 | 47008 | ACATCAATTTCAGAGACATG | 33 | 515 |
| 1100772 | 2464 | 2483 | 46990 | 47009 | AACATCAATTTCAGAGACAT | 24 | 516 |
| 1100773 | 2465 | 2484 | 46991 | 47010 | AAACATCAATTTCAGAGACA | 48 | 517 |
| 1100774 | 2472 | 2491 | 46998 | 47017 | GAAACTAAAACATCAATTTC | 104 | 518 |
| 1100775 | 2475 | 2494 | 47001 | 47020 | ACTGAAACTAAAACATCAAT | 114 | 519 |
| 1100776 | 2516 | 2535 | 47042 | 47061 | AAAGAGCTTCAAAAGGAGAT | 55 | 520 |
| 1100777 | 2525 | 2544 | 47051 | 47070 | CAACATTCAAAAGAGCTTCA | 40 | 521 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100778 | 2526 | 2545 | 47052 | 47071 | TCAACATTCAAAAGAGCTTC | 53 | 522 |
| 1100779 | 2527 | 2546 | 47053 | 47072 | TTCAACATTCAAAAGAGCTT | 65 | 523 |
| 1100780 | 2530 | 2549 | 47056 | 47075 | CAATTCAACATTCAAAAGAG | 64 | 524 |
| 1100781 | 2531 | 2550 | 47057 | 47076 | ACAATTCAACATTCAAAAGA | 97 | 525 |
| 1100782 | 2532 | 2551 | 47058 | 47077 | AACAATTCAACATTCAAAAG | 68 | 526 |
| 1100783 | 2533 | 2552 | 47059 | 47078 | GAACAATTCAACATTCAAAA | 39 | 527 |
| 1100784 | 2534 | 2553 | 47060 | 47079 | TGAACAATTCAACATTCAAA | 53 | 528 |
| 1100785 | 2535 | 2554 | 47061 | 47080 | ATGAACAATTCAACATTCAA | 57 | 529 |
| 1100786 | 2536 | 2555 | 47062 | 47081 | TATGAACAATTCAACATTCA | 67 | 530 |
| 1100787 | 2537 | 2556 | 47063 | 47082 | TTATGAACAATTCAACATTC | 50 | 531 |
| 1100788 | 2539 | 2558 | 47065 | 47084 | GCTTATGAACAATTCAACAT | 21 | 532 |
| 1100790 | 2543 | 2562 | 47069 | 47088 | TTTAGCTTATGAACAATTCA | 60 | 533 |
| 1100792 | 2553 | 2572 | 47079 | 47098 | TTTCTTGGATTTTAGCTTAT | 32 | 534 |
| 1100793 | 2561 | 2580 | 47087 | 47106 | AGCTGAAATTTCTTGGATTT | 48 | 535 |
| 1100794 | 2562 | 2581 | 47088 | 47107 | CAGCTGAAATTTCTTGGATT | 54 | 536 |
| 1100795 | 2563 | 2582 | 47089 | 47108 | TCAGCTGAAATTTCTTGGAT | 38 | 537 |
| 1100796 | 2564 | 2583 | 47090 | 47109 | GTCAGCTGAAATTTCTTGGA | 17 | 538 |
| 1100797 | 2566 | 2585 | 47092 | 47111 | TTGTCAGCTGAAATTTCTTG | 30 | 539 |
| 1100798 | 2568 | 2587 | 47094 | 47113 | AGTTGTCAGCTGAAATTTCT | 33 | 540 |
| 1100799 | 2569 | 2588 | 47095 | 47114 | AAGTTGTCAGCTGAAATTTC | 34 | 541 |
| 1100800 | 2570 | 2589 | 47096 | 47115 | GAAGTTGTCAGCTGAAATTT | 84 | 542 |
| 1100801 | 2571 | 2590 | 47097 | 47116 | CGAAGTTGTCAGCTGAAATT | 23 | 543 |
| 1100802 | 2572 | 2591 | 47098 | 47117 | TCGAAGTTGTCAGCTGAAAT | 16 | 544 |
| 1100803 | 2573 | 2592 | 47099 | 47118 | TTCGAAGTTGTCAGCTGAAA | 24 | 545 |
| 1100804 | 2574 | 2593 | 47100 | 47119 | TTTCGAAGTTGTCAGCTGAA | 26 | 546 |
| 1100805 | 2576 | 2595 | 47102 | 47121 | ATTTTCGAAGTTGTCAGCTG | 42 | 547 |
| 1100806 | 2583 | 2602 | 47109 | 47128 | TATTATAATTTTCGAAGTTG | 53 | 548 |
| 1100807 | 2585 | 2604 | 47111 | 47130 | CATATTATAATTTTCGAAGT | 71 | 549 |
| 1100808 | 2590 | 2609 | 47116 | 47135 | TATACCATATTATAATTTTC | 56 | 550 |
| 1100809 | 2595 | 2614 | 47121 | 47140 | GGCAATATACCATATTATAA | 14 | 551 |
| 1100810 | 2597 | 2616 | 47123 | 47142 | AGGGCAATATACCATATTAT | 17 | 552 |
| 1100811 | 2598 | 2617 | 47124 | 47143 | GAGGGCAATATACCATATTA | 25 | 553 |
| 1100812 | 2642 | 2661 | 47168 | 47187 | ATCAAAAACTTTCCCTGAT | 79 | 554 |
| 1100813 | 2643 | 2662 | 47169 | 47188 | GATCAAAAACTTTCCCTGA | 70 | 555 |
| 1100814 | 2644 | 2663 | 47170 | 47189 | AGATCAAAAACTTTCCCTG | 58 | 556 |
| 1100815 | 2646 | 2665 | 47172 | 47191 | CTAGATCAAAAACTTTCCC | 75 | 557 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100816 | 2647 | 2666 | 47173 | 47192 | CCTAGATCAAAAAACTTTCC | 58 | 558 |
| 1100817 | 2648 | 2667 | 47174 | 47193 | TCCTAGATCAAAAAACTTTC | 91 | 559 |
| 1100818 | 2649 | 2668 | 47175 | 47194 | ATCCTAGATCAAAAAACTTT | 62 | 560 |
| 1100819 | 2650 | 2669 | 47176 | 47195 | AATCCTAGATCAAAAAACTT | 62 | 561 |
| 1100820 | 2651 | 2670 | 47177 | 47196 | AAATCCTAGATCAAAAAACT | 92 | 562 |
| 1100821 | 2652 | 2671 | 47178 | 47197 | TAAATCCTAGATCAAAAAAC | 75 | 563 |
| 1100822 | 2656 | 2675 | 47182 | 47201 | GCAATAAATCCTAGATCAAA | 50 | 564 |
| 1100823 | 2657 | 2676 | 47183 | 47202 | AGCAATAAATCCTAGATCAA | 51 | 565 |
| 1100824 | 2658 | 2677 | 47184 | 47203 | TAGCAATAAATCCTAGATCA | 66 | 566 |
| 1100826 | 2660 | 2679 | 47186 | 47205 | GTTAGCAATAAATCCTAGAT | 29 | 567 |
| 1100828 | 2700 | 2719 | 47226 | 47245 | AATCATAAATAAAGATATT | 87 | 568 |
| 1100829 | 2701 | 2720 | 47227 | 47246 | TAATCATAAATAAAGATAT | 98 | 569 |
| 1100830 | 2712 | 2731 | 47238 | 47257 | AAGCTATTTTATAATCATAA | 72 | 570 |
| 1100831 | 2714 | 2733 | 47240 | 47259 | AAAAGCTATTTTATAATCAT | 78 | 571 |
| 1100832 | 2739 | 2758 | 47265 | 47284 | CTTAAAAAATCTGTTATATC | 78 | 572 |
| 1100833 | 2741 | 2760 | 47267 | 47286 | GACTTAAAAAATCTGTTATA | 83 | 573 |
| 1100834 | 2742 | 2761 | 47268 | 47287 | TGACTTAAAAAATCTGTTAT | 88 | 574 |
| 1100835 | 2743 | 2762 | 47269 | 47288 | ATGACTTAAAAAATCTGTTA | 67 | 575 |
| 1100836 | 2744 | 2763 | 47270 | 47289 | AATGACTTAAAAAATCTGTT | 77 | 576 |
| 1100837 | 2745 | 2764 | 47271 | 47290 | TAATGACTTAAAAAATCTGT | 83 | 577 |
| 1100838 | 2753 | 2772 | 47279 | 47298 | GCACAAAATAATGACTTAAA | 38 | 578 |
| 1100839 | 2754 | 2773 | 47280 | 47299 | GGCACAAAATAATGACTTAA | 8 | 579 |
| 1100840 | 2755 | 2774 | 47281 | 47300 | TGGCACAAAATAATGACTTA | 28 | 580 |
| 1100841 | 2756 | 2775 | 47282 | 47301 | TTGGCACAAAATAATGACTT | 42 | 581 |
| 1100842 | 2758 | 2777 | 47284 | 47303 | GATTGGCACAAAATAATGAC | 39 | 582 |
| 1100843 | 2778 | 2797 | 47304 | 47323 | AAGGGAAACTTCAGAAAACT | 41 | 583 |
| 1100844 | 2779 | 2798 | 47305 | 47324 | TAAGGGAAACTTCAGAAAAC | 74 | 584 |
| 1100845 | 2780 | 2799 | 47306 | 47325 | GTAAGGGAAACTTCAGAAAA | 42 | 585 |
| 1100846 | 2781 | 2800 | 47307 | 47326 | TGTAAGGGAAACTTCAGAAA | 24 | 586 |
| 1100847 | 2810 | 2829 | 47336 | 47355 | TTAGATTTTAAAATAAAGCT | 95 | 587 |
| 1100848 | 2830 | 2849 | 47356 | 47375 | TTTAACTATTAAAGAAACT | 91 | 588 |
| 1100849 | 2840 | 2859 | 47366 | 47385 | CTGAAACATTTTTAACTATT | 60 | 589 |
| 1100850 | 2849 | 2868 | 47375 | 47394 | ATAATTCTTCTGAAACATTT | 59 | 590 |
| 1100851 | 2851 | 2870 | 47377 | 47396 | TTATAATTCTTCTGAAACAT | 58 | 591 |
| 1100852 | 2852 | 2871 | 47378 | 47397 | TTTATAATTCTTCTGAAACA | 79 | 592 |
| 1100853 | 2853 | 2872 | 47379 | 47398 | TTTTATAATTCTTCTGAAAC | 112 | 593 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100854 | 2854 | 2873 | 47380 | 47399 | GTTTTATAATTCTTCTGAAA | 58 | 594 |
| 1100855 | 2855 | 2874 | 47381 | 47400 | AGTTTTATAATTCTTCTGAA | 61 | 595 |
| 1100856 | 2856 | 2875 | 47382 | 47401 | AAGTTTTATAATTCTTCTGA | 59 | 596 |
| 1100857 | 2858 | 2877 | 47384 | 47403 | TAAAGTTTTATAATTCTTCT | 87 | 597 |
| 1100858 | 2859 | 2878 | 47385 | 47404 | TTAAAGTTTTATAATTCTTC | 79 | 598 |
| 1100859 | 2862 | 2881 | 47388 | 47407 | GTTTTAAAGTTTTATAATTC | 96 | 599 |
| 1100860 | 2867 | 2886 | 47393 | 47412 | TTGCAGTTTTAAAGTTTTAT | 82 | 600 |
| 1100862 | 2908 | 2927 | 47434 | 47453 | TTTTTAAATCTTGAGGGAGT | 51 | 601 |
| 1100864 | 2912 | 2931 | 47438 | 47457 | TAGCTTTTTAAATCTTGAGG | 11 | 602 |
| 1100865 | 2913 | 2932 | 47439 | 47458 | TTAGCTTTTTAAATCTTGAG | 11 | 603 |
| 1100866 | 2914 | 2933 | 47440 | 47459 | TTTAGCTTTTTAAATCTTGA | 60 | 604 |
| 1100867 | 2915 | 2934 | 47441 | 47460 | ATTTAGCTTTTTAAATCTTG | 84 | 605 |
| 1100868 | 2916 | 2935 | 47442 | 47461 | TATTTAGCTTTTTAAATCTT | 96 | 606 |
| 1100869 | 2924 | 2943 | 47450 | 47469 | TCTTAAAATATTTAGCTTTT | 87 | 607 |
| 1100870 | 2925 | 2944 | 47451 | 47470 | GTCTTAAAATATTTAGCTTT | 45 | 608 |
| 1100871 | 2926 | 2945 | 47452 | 47471 | AGTCTTAAAATATTTAGCTT | 58 | 609 |
| 1100872 | 2927 | 2946 | 47453 | 47472 | CAGTCTTAAAATATTTAGCT | 85 | 610 |
| 1100873 | 2928 | 2947 | 47454 | 47473 | TCAGTCTTAAAATATTTAGC | 7 | 611 |
| 1100874 | 2929 | 2948 | 47455 | 47474 | TTCAGTCTTAAAATATTTAG | 78 | 612 |
| 1100875 | 2930 | 2949 | 47456 | 47475 | GTTCAGTCTTAAAATATTTA | 26 | 613 |
| 1100876 | 2932 | 2951 | 47458 | 47477 | ATGTTCAGTCTTAAAATATT | 47 | 614 |
| 1100877 | 2935 | 2954 | 47461 | 47480 | TAAATGTTCAGTCTTAAAAT | 98 | 615 |
| 1100878 | 2936 | 2955 | 47462 | 47481 | ATAAATGTTCAGTCTTAAAA | 94 | 616 |
| 1100879 | 2948 | 2967 | 47474 | 47493 | GTAATAATTAACATAAATGT | 95 | 617 |
| 1100880 | 2951 | 2970 | 47477 | 47496 | CTGGTAATAATTAACATAAA | 110 | 618 |
| 1100881 | 2952 | 2971 | 47478 | 47497 | ACTGGTAATAATTAACATAA | 54 | 619 |
| 1100882 | 2974 | 2993 | 47500 | 47519 | CCATGGAAAATATGACAAAC | 44 | 620 |
| 1100883 | 2982 | 3001 | 47508 | 47527 | ACAAATATCCATGGAAAATA | 76 | 621 |
| 1100884 | 2983 | 3002 | 47509 | 47528 | AACAAATATCCATGGAAAAT | 70 | 622 |
| 1100885 | 2984 | 3003 | 47510 | 47529 | GAACAAATATCCATGGAAAA | 43 | 623 |
| 1100886 | 2985 | 3004 | 47511 | 47530 | TGAACAAATATCCATGGAAA | 49 | 624 |
| 1100887 | 2987 | 3006 | 47513 | 47532 | AATGAACAAATATCCATGGA | 50 | 625 |
| 1100888 | 2988 | 3007 | 47514 | 47533 | TAATGAACAAATATCCATGG | 43 | 626 |
| 1100889 | 2989 | 3008 | 47515 | 47534 | GTAATGAACAAATATCCATG | 27 | 627 |
| 1100890 | 2990 | 3009 | 47516 | 47535 | GGTAATGAACAAATATCCAT | 52 | 628 |
| 1100891 | 2991 | 3010 | 47517 | 47536 | AGGTAATGAACAAATATCCA | 40 | 629 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100892 | 2996 | 3015 | 47522 | 47541 | GAAAAAGGTAATGAACAAAT | 84 | 630 |
| 1100893 | 3031 | 3050 | 47557 | 47576 | CAAGTGTATGAAAAGTTTAA | 75 | 631 |
| 1100894 | 3038 | 3057 | 47564 | 47583 | ATCAATTCAAGTGTATGAAA | 83 | 632 |
| 1100895 | 3040 | 3059 | 47566 | 47585 | TCATCAATTCAAGTGTATGA | 35 | 633 |
| 1100896 | 3041 | 3060 | 47567 | 47586 | CTCATCAATTCAAGTGTATG | 42 | 634 |
| 1100898 | 3043 | 3062 | 47569 | 47588 | AGCTCATCAATTCAAGTGTA | 18 | 635 |
| 1100900 | 3045 | 3064 | 47571 | 47590 | GTAGCTCATCAATTCAAGTG | 16 | 636 |
| 1100901 | 3046 | 3065 | 47572 | 47591 | GGTAGCTCATCAATTCAAGT | 17 | 637 |
| 1100902 | 3047 | 3066 | 47573 | 47592 | AGGTAGCTCATCAATTCAAG | 20 | 638 |
| 1100903 | 3048 | 3067 | 47574 | 47593 | TAGGTAGCTCATCAATTCAA | 16 | 639 |
| 1100904 | 3049 | 3068 | 47575 | 47594 | TTAGGTAGCTCATCAATTCA | 33 | 640 |
| 1100905 | 3051 | 3070 | 47577 | 47596 | TATTAGGTAGCTCATCAATT | 36 | 641 |
| 1100906 | 3060 | 3079 | 47586 | 47605 | TCATTTTATATTAGGTAGC | 15 | 642 |
| 1100907 | 3061 | 3080 | 47587 | 47606 | CTCATTTTATATTAGGTAG | 11 | 643 |
| 1100908 | 3062 | 3081 | 47588 | 47607 | TCTCATTTTATATTAGGTA | 112 | 644 |
| 1100909 | 3069 | 3088 | 47595 | 47614 | TTGGTTTTCTCATTTTATA | 23 | 645 |
| 1100910 | 3070 | 3089 | 47596 | 47615 | ATTGGTTTTCTCATTTTAT | 21 | 646 |
| 1100911 | 3071 | 3090 | 47597 | 47616 | TATTGGTTTTCTCATTTTA | 15 | 647 |
| 1100912 | 3072 | 3091 | 47598 | 47617 | ATATTGGTTTTCTCATTTT | 34 | 648 |
| 1100913 | 3073 | 3092 | 47599 | 47618 | CATATTGGTTTTCTCATTT | 24 | 649 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 78 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 5 | 45 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100914 | 3074 | 3093 | 47600 | 47619 | GCATATTGGTTTTCTCATTT | 4 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 9 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 4 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 6 | 45 |
| 1100914 | 3074 | 3093 | 47600 | 47619 | GCATATTGGTTTTCTCATTT | 5 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 7 | 45 |
| 1100914 | 3074 | 3093 | 47600 | 47619 | GCATATTGGTTTTCTCATTT | 5 | 45 |
| 1100915 | 3075 | 3094 | 47601 | 47620 | TGCATATTGGTTTTCTCATT | 8 | 650 |
| 1100916 | 3076 | 3095 | 47602 | 47621 | ATGCATATTGGTTTTCTCAT | 10 | 651 |
| 1100917 | 3077 | 3096 | 47603 | 47622 | AATGCATATTGGTTTTCTCA | 8 | 652 |
| 1100918 | 3079 | 3098 | 47605 | 47624 | AAAATGCATATTGGTTTTCT | 22 | 653 |
| 1100919 | 3116 | 3135 | 47642 | 47661 | TATATATGAACTTTATAAAC | 74 | 654 |
| 1100920 | 3119 | 3138 | 47645 | 47664 | GGGTATATATGAACTTTATA | 8 | 655 |
| 1100921 | 3122 | 3141 | 47648 | 47667 | CTAGGGTATATATGAACTTT | 21 | 656 |
| 1100922 | 3123 | 3142 | 47649 | 47668 | ACTAGGGTATATATGAACTT | 24 | 657 |
| 1100923 | 3124 | 3143 | 47650 | 47669 | AACTAGGGTATATATGAACT | 24 | 658 |
| 1100924 | 3133 | 3152 | 47659 | 47678 | AAGTGCTTTAACTAGGGTAT | 16 | 659 |
| 1100925 | 3134 | 3153 | 47660 | 47679 | TAAGTGCTTTAACTAGGGTA | 19 | 660 |
| 1100926 | 3135 | 3154 | 47661 | 47680 | TTAAGTGCTTTAACTAGGGT | 55 | 661 |
| 1100927 | 3140 | 3159 | 47666 | 47685 | TTTTCTTAAGTGCTTTAACT | 53 | 662 |
| 1100928 | 3146 | 3165 | 47672 | 47691 | GCCATATTTTCTTAAGTGCT | 18 | 663 |
| 1100929 | 3162 | 3181 | 47688 | 47707 | ACTAAAAGTCAAACATGCCA | 43 | 664 |
| 1100930 | 3164 | 3183 | 47690 | 47709 | GAACTAAAAGTCAAACATGC | 44 | 665 |
| 1100931 | 3507 | 3526 | 48033 | 48052 | GCTCTGCTTTAAAAACTCTC | 89 | 666 |
| 1100932 | 3536 | 3555 | 48062 | 48081 | CACATTCAAACGCATCCAGT | 49 | 667 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100933 | 3537 | 3556 | 48063 | 48082 | ACACATTCAAACGCATCCAG | 39 | 668 |
| 1100935 | 3540 | 3559 | 48066 | 48085 | CAAACACATTCAAACGCATC | 85 | 669 |
| 1100937 | 3542 | 3561 | 48068 | 48087 | CACAAACACATTCAAACGCA | 69 | 670 |
| 1100938 | 3544 | 3563 | 48070 | 48089 | TACACAAACACATTCAAACG | 76 | 671 |
| 1100939 | 3545 | 3564 | 48071 | 48090 | CTACACAAACACATTCAAAC | 57 | 672 |
| 1100940 | 3546 | 3565 | 48072 | 48091 | ACTACACAAACACATTCAAA | 82 | 673 |
| 1100941 | 3549 | 3568 | 48075 | 48094 | CAAACTACACAAACACATTC | 76 | 674 |
| 1100942 | 3550 | 3569 | 48076 | 48095 | ACAAACTACACAAACACATT | 95 | 675 |
| 1100943 | 3551 | 3570 | 48077 | 48096 | AACAAACTACACAAACACAT | 66 | 676 |
| 1100944 | 3554 | 3573 | 48080 | 48099 | CACAACAAACTACACAAACA | 65 | 677 |
| 1100945 | 3555 | 3574 | 48081 | 48100 | TCACAACAAACTACACAAAC | 92 | 678 |
| 1100946 | 3556 | 3575 | 48082 | 48101 | TTCACAACAAACTACACAAA | 88 | 679 |
| 1100947 | 3558 | 3577 | 48084 | 48103 | ATTTCACAACAAACTACACA | 78 | 680 |
| 1100948 | 3559 | 3578 | 48085 | 48104 | AATTTCACAACAAACTACAC | 66 | 681 |
| 1100949 | 3560 | 3579 | 48086 | 48105 | CAATTTCACAACAAACTACA | 93 | 682 |
| 1100950 | 3563 | 3582 | 48089 | 48108 | TAACAATTTCACAACAAACT | 89 | 683 |
| 1100951 | 3564 | 3583 | 48090 | 48109 | GTAACAATTTCACAACAAAC | 38 | 684 |
| 1100952 | 3565 | 3584 | 48091 | 48110 | TGTAACAATTTCACAACAAA | 52 | 685 |
| 1100953 | 3566 | 3585 | 48092 | 48111 | ATGTAACAATTTCACAACAA | 35 | 686 |
| 1100954 | 3567 | 3586 | 48093 | 48112 | AATGTAACAATTTCACAACA | 61 | 687 |
| 1100955 | 3568 | 3587 | 48094 | 48113 | AAATGTAACAATTTCACAAC | 73 | 688 |
| 1100956 | 3569 | 3588 | 48095 | 48114 | TAAATGTAACAATTTCACAA | 104 | 689 |
| 1100957 | 3570 | 3589 | 48096 | 48115 | CTAAATGTAACAATTTCACA | 87 | 690 |
| 1100958 | 3571 | 3590 | 48097 | 48116 | GCTAAATGTAACAATTTCAC | 46 | 691 |
| 1100959 | 3576 | 3595 | 48102 | 48121 | TGCCTGCTAAATGTAACAAT | 66 | 692 |
| 1100960 | 3582 | 3601 | 48108 | 48127 | TGGATCTGCCTGCTAAATGT | 42 | 693 |
| 1100961 | 3616 | 3635 | 48142 | 48161 | CAACCCCACCAAGATGACAG | 68 | 694 |
| 1100962 | 3621 | 3640 | 48147 | 48166 | TAAGCCAACCCCACCAAGAT | 88 | 695 |
| 1100963 | 3622 | 3641 | 48148 | 48167 | TTAAGCCAACCCCACCAAGA | 53 | 696 |
| 1100964 | 3626 | 3645 | 48152 | 48171 | AAATTTAAGCCAACCCCACC | 83 | 697 |
| 1100965 | 3627 | 3646 | 48153 | 48172 | TAAATTTAAGCCAACCCCAC | 134 | 698 |
| 1100966 | 3633 | 3652 | 48159 | 48178 | GTCAATTAAATTTAAGCCAA | 41 | 699 |
| 1100967 | 3636 | 3655 | 48162 | 48181 | ACAGTCAATTAAATTTAAGC | 72 | 700 |
| 1100968 | 3644 | 3663 | 48170 | 48189 | GAATCTAAACAGTCAATTAA | 75 | 701 |
| 1100969 | 3648 | 3667 | 48174 | 48193 | AATGGAATCTAAACAGTCAA | 78 | 702 |
| 1100971 | 3668 | 3687 | 48194 | 48213 | TACTGGCCAATCAATTAAGA | 73 | 703 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100973 | 3672 | 3691 | 48198 | 48217 | TTCATACTGGCCAATCAATT | 60 | 704 |
| 1100974 | 3674 | 3693 | 48200 | 48219 | TTTTCATACTGGCCAATCAA | 64 | 705 |
| 1100975 | 3676 | 3695 | 48202 | 48221 | TCTTTTCATACTGGCCAATC | 71 | 706 |
| 1100976 | 3677 | 3696 | 48203 | 48222 | ATCTTTTCATACTGGCCAAT | 52 | 707 |
| 1100977 | 3678 | 3697 | 48204 | 48223 | CATCTTTTCATACTGGCCAA | 50 | 708 |
| 1100978 | 3679 | 3698 | 48205 | 48224 | GCATCTTTTCATACTGGCCA | 35 | 709 |
| 1100979 | 3680 | 3699 | 48206 | 48225 | GGCATCTTTTCATACTGGCC | 29 | 710 |
| 1100980 | 3681 | 3700 | 48207 | 48226 | TGGCATCTTTTCATACTGGC | 14 | 711 |
| 1100981 | 3682 | 3701 | 48208 | 48227 | CTGGCATCTTTTCATACTGG | 104 | 712 |
| 1100982 | 3684 | 3703 | 48210 | 48229 | CACTGGCATCTTTTCATACT | 28 | 713 |
| 1100983 | 3699 | 3718 | 48225 | 48244 | TACTATGGTTACTTGCACTG | 35 | 714 |
| 1100984 | 3730 | 3749 | 48256 | 48275 | TATAGCTTTGAATAATTTTT | 121 | 715 |
| 1100985 | 3740 | 3759 | 48266 | 48285 | ATGTATAAACTATAGCTTTG | 37 | 716 |
| 1100986 | 3742 | 3761 | 48268 | 48287 | TGATGTATAAACTATAGCTT | 53 | 717 |
| 1100987 | 3747 | 3766 | 48273 | 48292 | GTACCTGATGTATAAACTAT | 51 | 718 |
| 1100988 | 3749 | 3768 | 48275 | 48294 | CAGTACCTGATGTATAAACT | 21 | 719 |
| 1100989 | 3750 | 3769 | 48276 | 48295 | GCAGTACCTGATGTATAAAC | 11 | 720 |
| 1100990 | 3751 | 3770 | 48277 | 48296 | GGCAGTACCTGATGTATAAA | 10 | 721 |
| 1100991 | 3752 | 3771 | 48278 | 48297 | TGGCAGTACCTGATGTATAA | 10 | 722 |
| 1100992 | 3753 | 3772 | 48279 | 48298 | ATGGCAGTACCTGATGTATA | 16 | 723 |
| 1100993 | 3754 | 3773 | 48280 | 48299 | AATGGCAGTACCTGATGTAT | 48 | 724 |
| 1100994 | 3755 | 3774 | 48281 | 48300 | AAATGGCAGTACCTGATGTA | 40 | 725 |
| 1100995 | 3757 | 3776 | 48283 | 48302 | GTAAATGGCAGTACCTGATG | 15 | 726 |
| 1100996 | 3764 | 3783 | 48290 | 48309 | GTTTACAGTAAATGGCAGTA | 18 | 727 |
| 1100997 | 3766 | 3785 | 48292 | 48311 | TGGTTTACAGTAAATGGCAG | 16 | 728 |
| 1100998 | 3768 | 3787 | 48294 | 48313 | GGTGGTTTACAGTAAATGGC | 25 | 729 |
| 1100999 | 3769 | 3788 | 48295 | 48314 | AGGTGGTTTACAGTAAATGG | 17 | 730 |
| 1101000 | 3771 | 3790 | 48297 | 48316 | GCAGGTGGTTTACAGTAAAT | 13 | 731 |
| 1101001 | 3782 | 3801 | 48308 | 48327 | CTGACTTTCTTGCAGGTGGT | 21 | 732 |
| 1101002 | 3785 | 3804 | 48311 | 48330 | TTCCTGACTTTCTTGCAGGT | 102 | 733 |
| 1101003 | 3786 | 3805 | 48312 | 48331 | GTTCCTGACTTTCTTGCAGG | 45 | 734 |
| 1101004 | 3788 | 3807 | 48314 | 48333 | TTGTTCCTGACTTTCTTGCA | 27 | 735 |
| 1101005 | 3791 | 3810 | 48317 | 48336 | TAGTTGTTCCTGACTTTCTT | 50 | 736 |
| 1101007 | 3793 | 3812 | 48319 | 48338 | TTTAGTTGTTCCTGACTTTC | 74 | 737 |
| 1101009 | 3838 | 3857 | 48364 | 48383 | AATGGAAATCTTTAATACAC | 64 | 738 |
| 1101010 | 3854 | 3873 | 48380 | 48399 | CCAATTAGTAAAACAAAATG | 104 | 739 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101011 | 3861 | 3880 | 48387 | 48406 | GATGTTCCCAATTAGTAAAA | 29 | 740 |
| 1101012 | 3863 | 3882 | 48389 | 48408 | AAGATGTTCCCAATTAGTAA | 29 | 741 |
| 1101013 | 3864 | 3883 | 48390 | 48409 | TAAGATGTTCCCAATTAGTA | 47 | 742 |
| 1101014 | 3870 | 3889 | 48396 | 48415 | AAACATTAAGATGTTCCCAA | 35 | 743 |
| 1101015 | 3871 | 3890 | 48397 | 48416 | TAAACATTAAGATGTTCCCA | 45 | 744 |
| 1101016 | 3873 | 3892 | 48399 | 48418 | ATTAAACATTAAGATGTTCC | 55 | 745 |
| 1101017 | 3874 | 3893 | 48400 | 48419 | TATTAAACATTAAGATGTTC | 90 | 746 |
| 1101018 | 3875 | 3894 | 48401 | 48420 | ATATTAAACATTAAGATGTT | 113 | 747 |
| 1101019 | 3877 | 3896 | 48403 | 48422 | AAATATTAAACATTAAGATG | 86 | 748 |
| 1101020 | 3878 | 3897 | 48404 | 48423 | TAAATATTAAACATTAAGAT | 90 | 749 |
| 1101021 | 3884 | 3903 | 48410 | 48429 | ATAGTTTAAATATTAAACAT | 99 | 750 |
| 1101022 | 3886 | 3905 | 48412 | 48431 | CAATAGTTTAAATATTAAAC | 119 | 751 |
| 1101023 | 3887 | 3906 | 48413 | 48432 | CCAATAGTTTAAATATTAAA | 111 | 752 |
| 1101024 | 3888 | 3907 | 48414 | 48433 | ACCAATAGTTTAAATATTAA | 98 | 753 |
| 1101025 | 3890 | 3909 | 48416 | 48435 | ATACCAATAGTTTAAATATT | 110 | 754 |
| 1101026 | 3896 | 3915 | 48422 | 48441 | AAAATGATACCAATAGTTTA | 78 | 755 |
| 1101027 | 3897 | 3916 | 48423 | 48442 | AAAAATGATACCAATAGTTT | 96 | 756 |
| 1101028 | 3898 | 3917 | 48424 | 48443 | GAAAAATGATACCAATAGTT | 67 | 757 |
| 1101029 | 3899 | 3918 | 48425 | 48444 | AGAAAAATGATACCAATAGT | 61 | 758 |
| 1101030 | 3900 | 3919 | 48426 | 48445 | TAGAAAAATGATACCAATAG | 61 | 759 |
| 1101031 | 3902 | 3921 | 48428 | 48447 | ATTAGAAAAATGATACCAAT | 75 | 760 |
| 1101032 | 3903 | 3922 | 48429 | 48448 | CATTAGAAAAATGATACCAA | 74 | 761 |
| 1101033 | 3905 | 3924 | 48431 | 48450 | TACATTAGAAAAATGATACC | 74 | 762 |
| 1101034 | 3906 | 3925 | 48432 | 48451 | ATACATTAGAAAAATGATAC | 119 | 763 |
| 1101035 | 3907 | 3926 | 48433 | 48452 | TATACATTAGAAAAATGATA | 94 | 764 |
| 1101036 | 3912 | 3931 | 48438 | 48457 | CAAATTATACATTAGAAAAA | 138 | 765 |
| 1101037 | 3913 | 3932 | 48439 | 48458 | ACAAATTATACATTAGAAAA | 83 | 766 |
| 1101038 | 3914 | 3933 | 48440 | 48459 | TACAAATTATACATTAGAAA | 70 | 767 |
| 1101039 | 3915 | 3934 | 48441 | 48460 | ATACAAATTATACATTAGAA | 113 | 768 |
| 1101040 | 3916 | 3935 | 48442 | 48461 | AATACAAATTATACATTAGA | 105 | 769 |
| 1101041 | 3917 | 3936 | 48443 | 48462 | TAATACAAATTATACATTAG | 85 | 770 |
| 1101043 | 3919 | 3938 | 48445 | 48464 | AGTAATACAAATTATACATT | 98 | 771 |
| 1101045 | 3922 | 3941 | 48448 | 48467 | CCCAGTAATACAAATTATAC | 74 | 772 |
| 1101046 | 3923 | 3942 | 48449 | 48468 | TCCCAGTAATACAAATTATA | 50 | 773 |
| 1101047 | 3924 | 3943 | 48450 | 48469 | ATCCCAGTAATACAAATTAT | 40 | 774 |
| 1101048 | 3925 | 3944 | 48451 | 48470 | GATCCCAGTAATACAAATTA | 47 | 775 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101049 | 3929 | 3948 | 48455 | 48474 | ACTTGATCCCAGTAATACAA | 21 | 776 |
| 1101050 | 3930 | 3949 | 48456 | 48475 | TACTTGATCCCAGTAATACA | 30 | 777 |
| 1101051 | 3931 | 3950 | 48457 | 48476 | ATACTTGATCCCAGTAATAC | 32 | 778 |
| 1101052 | 3932 | 3951 | 48458 | 48477 | CATACTTGATCCCAGTAATA | 29 | 779 |
| 1101053 | 3935 | 3954 | 48461 | 48480 | GTACATACTTGATCCCAGTA | 89 | 780 |
| 1101054 | 3937 | 3956 | 48463 | 48482 | CTGTACATACTTGATCCCAG | 15 | 781 |
| 1101055 | 3941 | 3960 | 48467 | 48486 | ACCACTGTACATACTTGATC | 32 | 782 |
| 1101056 | 3942 | 3961 | 48468 | 48487 | CACCACTGTACATACTTGAT | 45 | 783 |
| 1101057 | 3947 | 3966 | 48473 | 48492 | AGCATCACCACTGTACATAC | 15 | 784 |
| 1101058 | 3948 | 3967 | 48474 | 48493 | TAGCATCACCACTGTACATA | 23 | 785 |
| 1101059 | 3950 | 3969 | 48476 | 48495 | ACTAGCATCACCACTGTACA | 79 | 786 |
| 1101060 | 3951 | 3970 | 48477 | 48496 | TACTAGCATCACCACTGTAC | 74 | 787 |
| 1101061 | 3960 | 3979 | 48486 | 48505 | TTAAACTTCTACTAGCATCA | 56 | 788 |
| 1101062 | 3964 | 3983 | 48490 | 48509 | AGGCTTAAACTTCTACTAGC | 33 | 789 |
| 1101063 | 3968 | 3987 | 48494 | 48513 | TCCAAGGCTTAAACTTCTAC | 27 | 790 |
| 1101064 | 3977 | 3996 | 48503 | 48522 | AGTGGTATTTCCAAGGCTTA | 23 | 791 |
| 1101065 | 3978 | 3997 | 48504 | 48523 | AAGTGGTATTTCCAAGGCTT | 13 | 792 |
| 1101066 | 3979 | 3998 | 48505 | 48524 | AAAGTGGTATTTCCAAGGCT | 18 | 793 |
| 1101067 | 3989 | 4008 | 48515 | 48534 | TGAAAATATGAAAGTGGTAT | 30 | 794 |
| 1101068 | 3990 | 4009 | 48516 | 48535 | CTGAAAATATGAAAGTGGTA | 47 | 795 |
| 1101069 | 3993 | 4012 | 48519 | 48538 | CATCTGAAAATATGAAAGTG | 105 | 796 |
| 1101070 | 3994 | 4013 | 48520 | 48539 | ACATCTGAAAATATGAAAGT | 111 | 797 |
| 1101071 | 3995 | 4014 | 48521 | 48540 | GACATCTGAAAATATGAAAG | 25 | 798 |
| 1101072 | 3996 | 4015 | 48522 | 48541 | TGACATCTGAAAATATGAAA | 84 | 799 |
| 1101073 | 3997 | 4016 | 48523 | 48542 | ATGACATCTGAAAATATGAA | 48 | 800 |
| 1101074 | 4004 | 4023 | 48530 | 48549 | TAAATCCATGACATCTGAAA | 59 | 801 |
| 1101075 | 4007 | 4026 | 48533 | 48552 | CATTAAATCCATGACATCTG | 36 | 802 |
| 1101076 | 4008 | 4027 | 48534 | 48553 | TCATTAAATCCATGACATCT | 51 | 803 |
| 1101077 | 4009 | 4028 | 48535 | 48554 | CTCATTAAATCCATGACATC | 96 | 804 |
| 1101079 | 4011 | 4030 | 48537 | 48556 | TACTCATTAAATCCATGACA | 53 | 805 |
| 1101081 | 4013 | 4032 | 48539 | 48558 | ATTACTCATTAAATCCATGA | 60 | 806 |
| 1101082 | 4015 | 4034 | 48541 | 48560 | AAATTACTCATTAAATCCAT | 62 | 807 |
| 1101083 | 4016 | 4035 | 48542 | 48561 | TAAATTACTCATTAAATCCA | 102 | 808 |
| 1101084 | 4017 | 4036 | 48543 | 48562 | ATAAATTACTCATTAAATCC | 71 | 809 |
| 1101085 | 4018 | 4037 | 48544 | 48563 | CATAAATTACTCATTAAATC | 75 | 810 |
| 1101086 | 4019 | 4038 | 48545 | 48564 | ACATAAATTACTCATTAAAT | 126 | 811 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101087 | 4020 | 4039 | 48546 | 48565 | AACATAAATTACTCATTAAA | 81 | 812 |
| 1101088 | 4021 | 4040 | 48547 | 48566 | AAACATAAATTACTCATTAA | 78 | 813 |
| 1101089 | 4022 | 4041 | 48548 | 48567 | AAAACATAAATTACTCATTA | 103 | 814 |
| 1101090 | 4023 | 4042 | 48549 | 48568 | AAAAACATAAATTACTCATT | 98 | 815 |
| 1101091 | 4044 | 4063 | 48570 | 48589 | AGATTAACTATTCTGAATTT | 89 | 816 |
| 1101092 | 4045 | 4064 | 48571 | 48590 | GAGATTAACTATTCTGAATT | 46 | 817 |
| 1101093 | 4046 | 4065 | 48572 | 48591 | AGAGATTAACTATTCTGAAT | 47 | 818 |
| 1101094 | 4047 | 4066 | 48573 | 48592 | CAGAGATTAACTATTCTGAA | 57 | 819 |
| 1101095 | 4048 | 4067 | 48574 | 48593 | TCAGAGATTAACTATTCTGA | 74 | 820 |
| 1101096 | 4051 | 4070 | 48577 | 48596 | AGATCAGAGATTAACTATTC | 34 | 821 |
| 1101097 | 4052 | 4071 | 48578 | 48597 | TAGATCAGAGATTAACTATT | 42 | 822 |
| 1101098 | 4057 | 4076 | 48583 | 48602 | GGTTTTAGATCAGAGATTAA | 22 | 823 |
| 1101099 | 4058 | 4077 | 48584 | 48603 | TGGTTTTAGATCAGAGATTA | 17 | 824 |
| 1101100 | 4059 | 4078 | 48585 | 48604 | ATGGTTTTAGATCAGAGATT | 23 | 825 |
| 1101101 | 4061 | 4080 | 48587 | 48606 | TGATGGTTTTAGATCAGAGA | 8 | 826 |
| 1101102 | 4079 | 4098 | 48605 | 48624 | ACCGTAAAAAACATAGATTG | 47 | 827 |
| 1101103 | 4081 | 4100 | 48607 | 48626 | TTACCGTAAAAAACATAGAT | 62 | 828 |
| 1101104 | 4099 | 4118 | 48625 | 48644 | ACTGAAATATTTACATGATT | 67 | 829 |
| 1101105 | 4108 | 4127 | 48634 | 48653 | GTTTATATTACTGAAATATT | 86 | 830 |
| 1101106 | 4111 | 4130 | 48637 | 48656 | ACAGTTTATATTACTGAAAT | 116 | 831 |
| 1101107 | 4112 | 4131 | 48638 | 48657 | AACAGTTTATATTACTGAAA | 91 | 832 |
| 1101108 | 4113 | 4132 | 48639 | 48658 | AAACAGTTTATATTACTGAA | 86 | 833 |
| 1101109 | 4114 | 4133 | 48640 | 48659 | CAAACAGTTTATATTACTGA | 116 | 834 |
| 1101110 | 4115 | 4134 | 48641 | 48660 | TCAAACAGTTTATATTACTG | 70 | 835 |
| 1101111 | 4117 | 4136 | 48643 | 48662 | TTTCAAACAGTTTATATTAC | 86 | 836 |
| 1101112 | 4120 | 4139 | 48646 | 48665 | CCTTTTCAAACAGTTTATAT | 63 | 837 |
| 1101113 | 4121 | 4140 | 48647 | 48666 | GCCTTTTCAAACAGTTTATA | 36 | 838 |
| 1101115 | 4124 | 4143 | 48650 | 48669 | GCAGCCTTTTCAAACAGTTT | 31 | 839 |
| 1101117 | 4126 | 4145 | 48652 | 48671 | CAGCAGCCTTTTCAAACAGT | 27 | 840 |
| 1101118 | 4128 | 4147 | 48654 | 48673 | TGCAGCAGCCTTTTCAAACA | 36 | 841 |
| 1101119 | 4138 | 4157 | 48664 | 48683 | AGAGTTTACCTGCAGCAGCC | 36 | 842 |
| 1101120 | 4140 | 4159 | 48666 | 48685 | ATAGAGTTTACCTGCAGCAG | 21 | 843 |
| 1101121 | 4141 | 4160 | 48667 | 48686 | TATAGAGTTTACCTGCAGCA | 14 | 844 |
| 1101122 | 4142 | 4161 | 48668 | 48687 | GTATAGAGTTTACCTGCAGC | 15 | 845 |
| 1101123 | 4144 | 4163 | 48670 | 48689 | TAGTATAGAGTTTACCTGCA | 32 | 846 |
| 1101124 | 4169 | 4188 | 48695 | 48714 | ATTGTAAATTATTTGGCCAA | 78 | 847 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101125 | 4170 | 4189 | 48696 | 48715 | AATTGTAAATTATTTGGCCA | 84 | 848 |
| 1101126 | 4171 | 4190 | 48697 | 48716 | GAATTGTAAATTATTTGGCC | 57 | 849 |
| 1101127 | 4172 | 4191 | 48698 | 48717 | TGAATTGTAAATTATTTGGC | 44 | 850 |
| 1101128 | 4173 | 4192 | 48699 | 48718 | GTGAATTGTAAATTATTTGG | 26 | 851 |
| 1101129 | 4178 | 4197 | 48704 | 48723 | ATTCTGTGAATTGTAAATTA | 42 | 852 |
| 1101130 | 4191 | 4210 | 48717 | 48736 | CCTTAAATAAAATATTCTGT | 87 | 853 |
| 1101131 | 4197 | 4216 | 48723 | 48742 | GCACCACCTTAAATAAAATA | 62 | 854 |
| 1101132 | 4200 | 4219 | 48726 | 48745 | AAAGCACCACCTTAAATAAA | 83 | 855 |
| 1101133 | 4224 | 4243 | 48750 | 48769 | ATCAAGTTTTAAGGACAAAA | 56 | 856 |
| 1101134 | 4226 | 4245 | 48752 | 48771 | AAATCAAGTTTTAAGGACAA | 88 | 857 |
| 1101135 | 4227 | 4246 | 48753 | 48772 | AAAATCAAGTTTTAAGGACA | 84 | 858 |
| 1101136 | 4228 | 4247 | 48754 | 48773 | AAAAATCAAGTTTTAAGGAC | 94 | 859 |
| 1101137 | 4236 | 4255 | 48762 | 48781 | AAGTTAAGAAAAATCAAGTT | 82 | 860 |
| 1101138 | 4253 | 4272 | 48779 | 48798 | CTTTGGCATCATGAATAAAG | 35 | 861 |
| 1101139 | 4330 | 4349 | 48856 | 48875 | AATATTAAACAATATGGACT | 54 | 862 |
| 1101140 | 4332 | 4351 | 48858 | 48877 | TTAATATTAAACAATATGGA | 88 | 863 |
| 1101141 | 4334 | 4353 | 48860 | 48879 | ACTTAATATTAAACAATATG | 114 | 864 |
| 1101142 | 4335 | 4354 | 48861 | 48880 | AACTTAATATTAAACAATAT | 87 | 865 |
| 1101143 | 4343 | 4362 | 48869 | 48888 | TTTTATTCAACTTAATATTA | 100 | 866 |
| 1101144 | 4352 | 4371 | 48878 | 48897 | TAAAATTTATTTTATTCAAC | 99 | 867 |
| 1101145 | 4380 | 4399 | 48906 | 48925 | CAAAATGTGATTTAGGCTCT | 34 | 868 |
| 1101146 | 4389 | 4408 | 48915 | 48934 | TCAGACAATCAAAATGTGAT | 44 | 869 |
| 1101147 | 4397 | 4416 | 48923 | 48942 | TCAAAAATTCAGACAATCAA | 85 | 870 |
| 1101148 | 4399 | 4418 | 48925 | 48944 | TATCAAAAATTCAGACAATC | 74 | 871 |
| 1101149 | 4400 | 4419 | 48926 | 48945 | GTATCAAAAATTCAGACAAT | 71 | 872 |
| 1101151 | 4403 | 4422 | 48929 | 48948 | ATAGTATCAAAAATTCAGAC | 84 | 873 |
| 1101153 | 4758 | 4777 | 49284 | 49303 | GGTTTTAAGAATTAGTAGC | 26 | 874 |
| 1101154 | 4759 | 4778 | 49285 | 49304 | CGGTTTTAAGAATTAGTAG | 57 | 875 |
| 1101155 | 4762 | 4781 | 49288 | 49307 | GGCCGGTTTTAAGAATTTAG | 74 | 876 |
| 1101156 | 4793 | 4812 | 49319 | 49338 | GAATCTATTTTTTATCTGTA | 33 | 877 |
| 1101157 | 4820 | 4839 | 49346 | 49365 | AAAATTATCATATTTTGATT | 76 | 878 |
| 1101158 | 4821 | 4840 | 49347 | 49366 | TAAAATTATCATATTTTGAT | 97 | 879 |
| 1101159 | 4827 | 4846 | 49353 | 49372 | AGATTTTAAAATTATCATAT | 79 | 880 |
| 1101160 | 4831 | 4850 | 49357 | 49376 | CTTAAGATTTTAAAATTATC | 94 | 881 |
| 1101161 | 4834 | 4853 | 49360 | 49379 | CTACTTAAGATTTTAAAATT | 116 | 882 |
| 1101162 | 4841 | 4860 | 49367 | 49386 | TATTTTCTACTTAAGATTT | 81 | 883 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101163 | 4843 | 4862 | 49369 | 49388 | TTTATTTTTCTACTTAAGAT | 130 | 884 |
| 1101164 | 4845 | 4864 | 49371 | 49390 | GATTTATTTTTCTACTTAAG | 85 | 885 |
| 1101165 | 4850 | 4869 | 49376 | 49395 | ATCAAGATTTATTTTTCTAC | 54 | 886 |
| 1101166 | 4851 | 4870 | 49377 | 49396 | CATCAAGATTTATTTTTCTA | 79 | 887 |
| 1101167 | 4853 | 4872 | 49379 | 49398 | AACATCAAGATTTATTTTTC | 90 | 888 |
| 1101168 | 4859 | 4878 | 49385 | 49404 | ATTTAAAACATCAAGATTTA | 98 | 889 |
| 1101169 | 4864 | 4883 | 49390 | 49409 | TAAGAATTTAAAACATCAAG | 63 | 890 |
| 1101170 | 4865 | 4884 | 49391 | 49410 | GTAAGAATTTAAAACATCAA | 76 | 891 |
| 1101171 | 4887 | 4906 | 49413 | 49432 | CAATATTAACTATTGAATCC | 88 | 892 |
| 1101172 | 5256 | 5275 | 49782 | 49801 | ATAAAGTTTTTAATAGGAAG | 99 | 893 |
| 1101173 | 5258 | 5277 | 49784 | 49803 | GGATAAAGTTTTTAATAGGA | 52 | 894 |
| 1101174 | 5556 | 5575 | 50082 | 50101 | CAAACAAACCTTTAAGATGG | 95 | 895 |
| 1101175 | 5557 | 5576 | 50083 | 50102 | ACAAACAAACCTTTAAGATG | 93 | 896 |
| 1101176 | 5575 | 5594 | 50101 | 50120 | TTTCCGGATTAAAAAAAAAC | 103 | 897 |
| 1101177 | 5801 | 5820 | 50327 | 50346 | AAAAAAAACAAATATTCGCC | 88 | 898 |
| 1101178 | 5802 | 5821 | 50328 | 50347 | TAAAAAAAACAAATATTCGC | 101 | 899 |
| 1101179 | 5947 | 5966 | 50473 | 50492 | AAACAATTCACTTTGAAAAC | 74 | 900 |
| 1101180 | 5950 | 5969 | 50476 | 50495 | AACAAACAATTCACTTTGAA | 62 | 901 |
| 1101181 | 5951 | 5970 | 50477 | 50496 | CAACAAACAATTCACTTTGA | 67 | 902 |
| 1101182 | 5952 | 5971 | 50478 | 50497 | ACAACAAACAATTCACTTTG | 44 | 903 |
| 1101183 | 5953 | 5972 | 50479 | 50498 | TACAACAAACAATTCACTTT | 102 | 904 |
| 1101184 | 5954 | 5973 | 50480 | 50499 | ATACAACAAACAATTCACTT | 63 | 905 |
| 1101185 | 5955 | 5974 | 50481 | 50500 | GATACAACAAACAATTCACT | 56 | 906 |
| 1101187 | 5958 | 5977 | 50484 | 50503 | CTCGATACAACAAACAATTC | 63 | 907 |
| 1101189 | 5960 | 5979 | 50486 | 50505 | GACTCGATACAACAAACAAT | 54 | 908 |
| 1101190 | 5961 | 5980 | 50487 | 50506 | GGACTCGATACAACAAACAA | 63 | 909 |
| 1101191 | 5962 | 5981 | 50488 | 50507 | AGGACTCGATACAACAAACA | 41 | 910 |
| 1101192 | 5963 | 5982 | 50489 | 50508 | AAGGACTCGATACAACAAAC | 38 | 911 |
| 1101193 | 5965 | 5984 | 50491 | 50510 | TTAAGGACTCGATACAACAA | 55 | 912 |
| 1101194 | 5976 | 5995 | 50502 | 50521 | TATATCCATACTTAAGGACT | 70 | 913 |
| 1101195 | 5986 | 6005 | 50512 | 50531 | GGGTCACATATATATCCATA | 71 | 914 |
| 1101196 | 5988 | 6007 | 50514 | 50533 | TAGGGTCACATATATATCCA | 51 | 915 |
| 1101197 | 5992 | 6011 | 50518 | 50537 | TAATTAGGGTCACATATATA | 98 | 916 |
| 1101198 | 5994 | 6013 | 50520 | 50539 | CTTAATTAGGGTCACATATA | 46 | 917 |
| 1101199 | 5995 | 6014 | 50521 | 50540 | TCTTAATTAGGGTCACATAT | 35 | 918 |
| 1101200 | 5996 | 6015 | 50522 | 50541 | TTCTTAATTAGGGTCACATA | 45 | 919 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101201 | 5997 | 6016 | 50523 | 50542 | GTTCTTAATTAGGGTCACAT | 20 | 920 |
| 1101202 | 5998 | 6017 | 50524 | 50543 | AGTTCTTAATTAGGGTCACA | 18 | 921 |
| 1101203 | 5999 | 6018 | 50525 | 50544 | TAGTTCTTAATTAGGGTCAC | 20 | 922 |
| 1101204 | 6000 | 6019 | 50526 | 50545 | GTAGTTCTTAATTAGGGTCA | 21 | 923 |
| 1101205 | 6002 | 6021 | 50528 | 50547 | TGGTAGTTCTTAATTAGGGT | 25 | 924 |
| 1101206 | 6018 | 6037 | 50544 | 50563 | ATTAGTTGATCCAATCTGGT | 52 | 925 |
| 1101207 | 6019 | 6038 | 50545 | 50564 | GATTAGTTGATCCAATCTGG | 40 | 926 |
| 1101208 | 6028 | 6047 | 50554 | 50573 | TGCTGACATGATTAGTTGAT | 41 | 927 |
| 1101209 | 6029 | 6048 | 50555 | 50574 | TTGCTGACATGATTAGTTGA | 51 | 928 |
| 1101210 | 6032 | 6051 | 50558 | 50577 | ACATTGCTGACATGATTAGT | 54 | 929 |
| 1101211 | 6041 | 6060 | 50567 | 50586 | AAGTTATTTACATTGCTGAC | 34 | 930 |
| 1101212 | 6044 | 6063 | 50570 | 50589 | ATAAAGTTATTTACATTGCT | 72 | 931 |
| 1101213 | 6045 | 6064 | 50571 | 50590 | AATAAAGTTATTTACATTGC | 86 | 932 |
| 1101214 | 6056 | 6075 | 50582 | 50601 | TGAATATGAAAAATAAAGTT | 112 | 933 |
| 1101215 | 6067 | 6086 | 50593 | 50612 | AGTTTTTATTTTGAATATGA | 75 | 934 |
| 1101216 | 6071 | 6090 | 50597 | 50616 | AGAAAGTTTTTATTTTGAAT | 99 | 935 |
| 1101217 | 6121 | 6140 | 50647 | 50666 | GTCATTTTTTAAAGCAAAAA | 110 | 936 |
| 1101218 | 6124 | 6143 | 50650 | 50669 | CAGGTCATTTTTTAAAGCAA | 32 | 937 |
| 1101219 | 6135 | 6154 | 50661 | 50680 | AAATACAAAGCCAGGTCATT | 64 | 938 |
| 1101220 | 6141 | 6160 | 50667 | 50686 | CTAAAAAATACAAAGCCAG | 111 | 939 |
| 1101221 | 6142 | 6161 | 50668 | 50687 | ACTAAAAAATACAAAGCCA | 55 | 940 |
| 1101223 | 6151 | 6170 | 50677 | 50696 | ATGTTTAAGACTAAAAAAAT | 90 | 941 |
| 1101225 | 6201 | 6220 | 50727 | 50746 | GTCAATAATCTTCACTCATG | 47 | 942 |
| 1101226 | 6205 | 6224 | 50731 | 50750 | CGATGTCAATAATCTTCACT | 71 | 943 |
| 1101227 | 6214 | 6233 | 50740 | 50759 | ATTTACCAACGATGTCAATA | 58 | 944 |
| 1101228 | 6216 | 6235 | 50742 | 50761 | GAATTTACCAACGATGTCAA | 58 | 945 |
| 1101229 | 6219 | 6238 | 50745 | 50764 | CTAGAATTACCAACGATGT | 49 | 946 |
| 1101230 | 6223 | 6242 | 50749 | 50768 | AATTCTAGAATTTACCAACG | 57 | 947 |
| 1101231 | 6224 | 6243 | 50750 | 50769 | AAATTCTAGAATTTACCAAC | 63 | 948 |
| 1101232 | 6225 | 6244 | 50751 | 50770 | AAAATTCTAGAATTTACCAA | 101 | 949 |
| 1101233 | 6228 | 6247 | 50754 | 50773 | ATCAAAATTCTAGAATTTAC | 85 | 950 |
| 1101234 | 6230 | 6249 | 50756 | 50775 | AAATCAAAATTCTAGAATTT | 95 | 951 |
| 1101235 | 6232 | 6251 | 50758 | 50777 | CAAAATCAAAATTCTAGAAT | 107 | 952 |
| 1101236 | 6301 | 6320 | 50827 | 50846 | ACTAATTCTTAAAATGCCAG | 66 | 953 |
| 1101237 | 6302 | 6321 | 50828 | 50847 | CACTAATTCTTAAAATGCCA | 64 | 954 |
| 1101238 | 6332 | 6351 | 50858 | 50877 | TTACGACAAATTTAGAAGTT | 100 | 955 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101239 | 6341 | 6360 | 50867 | 50886 | ACATGCCAATTACGACAAAT | 65 | 956 |
| 1101240 | 6351 | 6370 | 50877 | 50896 | ATGCTATTAAACATGCCAAT | 52 | 957 |
| 1101241 | 6353 | 6372 | 50879 | 50898 | ATATGCTATTAAACATGCCA | 28 | 958 |
| 1101242 | 6354 | 6373 | 50880 | 50899 | GATATGCTATTAAACATGCC | 75 | 959 |
| 1101243 | 6355 | 6374 | 50881 | 50900 | TGATATGCTATTAAACATGC | 63 | 960 |
| 1101244 | 6363 | 6382 | 50889 | 50908 | ATGTTTTTGATATGCTATT | 60 | 961 |
| 1101245 | 6364 | 6383 | 50890 | 50909 | AATGTTTTTGATATGCTAT | 38 | 962 |
| 1101246 | 6365 | 6384 | 50891 | 50910 | AAATGTTTTTGATATGCTA | 69 | 963 |
| 1101247 | 6366 | 6385 | 50892 | 50911 | AAAATGTTTTTGATATGCT | 75 | 964 |
| 1101248 | 6376 | 6395 | 50902 | 50921 | CCACAGGCTTAAAATGTTTT | 87 | 965 |
| 1101249 | 6384 | 6403 | 50910 | 50929 | CTATGAATCCACAGGCTTAA | 47 | 966 |
| 1101250 | 6406 | 6425 | 50932 | 50951 | CTAATGTTTCTCATTGCTTT | 48 | 967 |
| 1101251 | 6420 | 6439 | 50946 | 50965 | CCATTTATATTTTACTAATG | 91 | 968 |
| 1101252 | 6423 | 6442 | 50949 | 50968 | TATCCATTTATATTTTACTA | 59 | 969 |
| 1101253 | 6427 | 6446 | 50953 | 50972 | GGAATATCCATTTATATTTT | 53 | 970 |
| 1101254 | 6447 | 6466 | 50973 | 50992 | AGAGCTTCCTAAATGCATCA | 62 | 971 |
| 1101255 | 6480 | 6499 | 51006 | 51025 | AAAACATTCCTTGAACTATG | 71 | 972 |
| 1101256 | 6482 | 6501 | 51008 | 51027 | AGAAAACATTCCTTGAACTA | 71 | 973 |
| 1101257 | 6484 | 6503 | 51010 | 51029 | TCAGAAAACATTCCTTGAAC | 77 | 974 |
| 1101259 | 6546 | 6565 | 51072 | 51091 | GATAATCACATTTAAAAATG | 82 | 975 |
| 1101261 | 6552 | 6571 | 51078 | 51097 | AAATTAGATAATCACATTTA | 107 | 976 |
| 1101262 | 6553 | 6572 | 51079 | 51098 | AAAATTAGATAATCACATTT | 95 | 977 |
| 1101263 | 6554 | 6573 | 51080 | 51099 | AAAAATTAGATAATCACATT | 112 | 978 |
| 1101264 | 6555 | 6574 | 51081 | 51100 | TAAAAATTAGATAATCACAT | 81 | 979 |
| 1101265 | 6557 | 6576 | 51083 | 51102 | TGTAAAAATTAGATAATCAC | 103 | 980 |
| 1101266 | 6560 | 6579 | 51086 | 51105 | TGTTGTAAAAATTAGATAAT | 119 | 981 |
| 1101267 | 6561 | 6580 | 51087 | 51106 | GTGTTGTAAAAATTAGATAA | 73 | 982 |
| 1101268 | 6562 | 6581 | 51088 | 51107 | AGTGTTGTAAAAATTAGATA | 88 | 983 |
| 1101269 | 6563 | 6582 | 51089 | 51108 | CAGTGTTGTAAAAATTAGAT | 81 | 984 |
| 1101270 | 6571 | 6590 | 51097 | 51116 | TAATAGCCCAGTGTTGTAAA | 46 | 985 |
| 1101271 | 6573 | 6592 | 51099 | 51118 | CCTAATAGCCCAGTGTTGTA | 39 | 986 |
| 1101272 | 6574 | 6593 | 51100 | 51119 | TCCTAATAGCCCAGTGTTGT | 48 | 987 |
| 1101273 | 6575 | 6594 | 51101 | 51120 | TTCCTAATAGCCCAGTGTTG | 49 | 988 |
| 1101274 | 6580 | 6599 | 51106 | 51125 | AGTTATTCCTAATAGCCCAG | 38 | 989 |
| 1101275 | 6581 | 6600 | 51107 | 51126 | AAGTTATTCCTAATAGCCCA | 56 | 990 |
| 1101276 | 6582 | 6601 | 51108 | 51127 | AAAGTTATTCCTAATAGCCC | 52 | 991 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101277 | 6583 | 6602 | 51109 | 51128 | AAAAGTTATTCCTAATAGCC | 60 | 992 |
| 1101278 | 6584 | 6603 | 51110 | 51129 | AAAAAGTTATTCCTAATAGC | 81 | 993 |
| 1101279 | 6585 | 6604 | 51111 | 51130 | TAAAAAGTTATTCCTAATAG | 78 | 994 |
| 1101280 | 6587 | 6606 | 51113 | 51132 | TTTAAAAAGTTATTCCTAAT | 108 | 995 |
| 1101281 | 6600 | 6619 | 51126 | 51145 | CAGAACAGTAATTTTTAAAA | 106 | 996 |
| 1101282 | 6604 | 6623 | 51130 | 51149 | TATACAGAACAGTAATTTTT | 64 | 997 |
| 1101283 | 6605 | 6624 | 51131 | 51150 | TTATACAGAACAGTAATTTT | 85 | 998 |
| 1101284 | 6606 | 6625 | 51132 | 51151 | TTTATACAGAACAGTAATTT | 95 | 999 |
| 1101285 | 6607 | 6626 | 51133 | 51152 | ATTTATACAGAACAGTAATT | 104 | 1000 |
| 1101286 | 6612 | 6631 | 51138 | 51157 | CAAATATTTATACAGAACAG | 78 | 1001 |
| 1101287 | 6614 | 6633 | 51140 | 51159 | TTCAAATATTTATACAGAAC | 70 | 1002 |
| 1101288 | 6615 | 6634 | 51141 | 51160 | TTTCAAATATTTATACAGAA | 42 | 1003 |
| 1101289 | 6616 | 6635 | 51142 | 51161 | ATTTCAAATATTTATACAGA | 87 | 1004 |
| 1101290 | 6618 | 6637 | 51144 | 51163 | GAATTTCAAATATTTATACA | 97 | 1005 |
| 1101291 | 6621 | 6640 | 51147 | 51166 | CTTGAATTTCAAATATTTAT | 94 | 1006 |
| 1101292 | 6636 | 6655 | 51162 | 51181 | CAGATATTTTCTGTACTTGA | 32 | 1007 |
| 1101293 | 6645 | 6664 | 51171 | 51190 | TTTTTGTTTCAGATATTTTC | 82 | 1008 |
| 1101295 | 6661 | 6680 | 51187 | 51206 | GGCCAAACAACAATGCTTTT | 72 | 1009 |
| 1101297 | 6664 | 6683 | 51190 | 51209 | CATGGCCAAACAACAATGCT | 83 | 1010 |
| 1101298 | 6665 | 6684 | 51191 | 51210 | TCATGGCCAAACAACAATGC | 80 | 1011 |
| 1101299 | 6667 | 6686 | 51193 | 51212 | TATCATGGCCAAACAACAAT | 76 | 1012 |
| 1101300 | 6674 | 6693 | 51200 | 51219 | GCACTTGTATCATGGCCAAA | 50 | 1013 |
| 1101301 | 6675 | 6694 | 51201 | 51220 | TGCACTTGTATCATGGCCAA | 64 | 1014 |
| 1101302 | 6750 | 6769 | 51276 | 51295 | AGCAAATGAACTTAACGAGG | 32 | 1015 |
| 1101303 | 6756 | 6775 | 51282 | 51301 | AATAACAGCAAATGAACTTA | 64 | 1016 |
| 1101304 | 6762 | 6781 | 51288 | 51307 | GTGTGTAATAACAGCAAATG | 52 | 1017 |
| 1101305 | 6764 | 6783 | 51290 | 51309 | GTGTGTGTAATAACAGCAAA | 81 | 1018 |
| 1101306 | 6765 | 6784 | 51291 | 51310 | TGTGTGTGTAATAACAGCAA | 65 | 1019 |
| 1101307 | 6798 | 6817 | 51324 | 51343 | GCCCGGCTTTTCTAACGACC | 77 | 1020 |
| 1101308 | 6839 | 6858 | 51365 | 51384 | CACACTAACAACAGAATCCT | 75 | 1021 |
| 1101309 | 6841 | 6860 | 51367 | 51386 | TCCACACTAACAACAGAATC | 94 | 1022 |
| 1101310 | 6842 | 6861 | 51368 | 51387 | ATCCACACTAACAACAGAAT | 72 | 1023 |
| 1101311 | 6844 | 6863 | 51370 | 51389 | ACATCCACACTAACAACAGA | 57 | 1024 |
| 1101312 | 6845 | 6864 | 51371 | 51390 | AACATCCACACTAACAACAG | 70 | 1025 |
| 1101313 | 6846 | 6865 | 51372 | 51391 | GAACATCCACACTAACAACA | 73 | 1026 |
| 1101314 | 6848 | 6867 | 51374 | 51393 | TTGAACATCCACACTAACAA | 73 | 1027 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101315 | 6851 | 6870 | 51377 | 51396 | TCATTGAACATCCACACTAA | 62 | 1028 |
| 1101316 | 6852 | 6871 | 51378 | 51397 | CTCATTGAACATCCACACTA | 70 | 1029 |
| 1101317 | 6853 | 6872 | 51379 | 51398 | ACTCATTGAACATCCACACT | 69 | 1030 |
| 1101318 | 6854 | 6873 | 51380 | 51399 | AACTCATTGAACATCCACAC | 67 | 1031 |
| 1101319 | 6860 | 6879 | 51386 | 51405 | AAATACAACTCATTGAACAT | 66 | 1032 |
| 1101320 | 6861 | 6880 | 51387 | 51406 | AAAATACAACTCATTGAACA | 88 | 1033 |
| 1101321 | 6862 | 6881 | 51388 | 51407 | TAAAATACAACTCATTGAAC | 81 | 1034 |
| 1101322 | 6863 | 6882 | 51389 | 51408 | TTAAAATACAACTCATTGAA | 102 | 1035 |
| 1101323 | 6865 | 6884 | 51391 | 51410 | ATTTAAAATACAACTCATTG | 73 | 1036 |
| 1101324 | 6867 | 6886 | 51393 | 51412 | ATATTTAAAATACAACTCAT | 101 | 1037 |
| 1101325 | 6868 | 6887 | 51394 | 51413 | GATATTTAAAATACAACTCA | 38 | 1038 |
| 1101326 | 6869 | 6888 | 51395 | 51414 | TGATATTTAAAATACAACTC | 83 | 1039 |
| 1101327 | 6870 | 6889 | 51396 | 51415 | TTGATATTTAAAATACAACT | 77 | 1040 |
| 1101328 | 6871 | 6890 | 51397 | 51416 | TTTGATATTTAAAATACAAC | 77 | 1041 |
| 1101329 | 6880 | 6899 | 51406 | 51425 | TTAATAATCTTTGATATTTA | 129 | 1042 |
| 1101331 | 6887 | 6906 | 51413 | 51432 | TCTTTATTTAATAATCTTTG | 80 | 1043 |
| 1101333 | 6891 | 6910 | 51417 | 51436 | ATTATCTTTATTTAATAATC | 91 | 1044 |
| 1101334 | 6895 | 6914 | 51421 | 51440 | AAACATTATCTTTATTTAAT | 79 | 1045 |
| 1101335 | 6902 | 6921 | 51428 | 51447 | GAAAAGCAAACATTATCTTT | 99 | 1046 |
| 1101336 | 90 | 109 | N/A | N/A | AAAGTGAGCCTTCTTGTTTC | 57 | 1047 |
| 1101337 | 92 | 111 | N/A | N/A | ACAAAGTGAGCCTTCTTGTT | 54 | 1048 |
| 1101338 | 93 | 112 | N/A | N/A | CACAAAGTGAGCCTTCTTGT | 62 | 1049 |
| 1101339 | 94 | 113 | 13163 | 13182 | GCACAAAGTGAGCCTTCTTG | 11 | 1050 |
| 1101340 | 95 | 114 | 13164 | 13183 | AGCACAAAGTGAGCCTTCTT | 35 | 1051 |
| 1101341 | 96 | 115 | 13165 | 13184 | GAGCACAAAGTGAGCCTTCT | 102 | 1052 |
| 1101342 | 97 | 116 | 13166 | 13185 | TGAGCACAAAGTGAGCCTTC | 75 | 1053 |
| 1101343 | 98 | 117 | 13167 | 13186 | TTGAGCACAAAGTGAGCCTT | 60 | 1054 |
| 1101344 | 100 | 119 | 13169 | 13188 | TGTTGAGCACAAAGTGAGCC | 45 | 1055 |
| 1101345 | 116 | 135 | 13185 | 13204 | TAAGTTATTCAGGCAATGTT | 35 | 1056 |
| 1101346 | 118 | 137 | 13187 | 13206 | AATAAGTTATTCAGGCAATG | 34 | 1057 |
| 1101347 | 136 | 155 | 13205 | 13224 | CTAAAATATTCTCCTTGCAA | 51 | 1058 |
| 1101348 | 137 | 156 | 13206 | 13225 | GCTAAAATATTCTCCTTGCA | 33 | 1059 |
| 1101349 | 138 | 157 | 13207 | 13226 | GGCTAAAATATTCTCCTTGC | 12 | 1060 |
| 1101350 | 152 | 171 | 13221 | 13240 | GGATAATTCCACAGGGCTAA | 13 | 1061 |
| 1101351 | 153 | 172 | 13222 | 13241 | AGGATAATTCCACAGGGCTA | 9 | 1062 |
| 1101352 | 154 | 173 | 13223 | 13242 | GAGGATAATTCCACAGGGCT | 12 | 1063 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101353 | 155 | 174 | 13224 | 13243 | TGAGGATAATTCCACAGGGC | 21 | 1064 |
| 1101354 | 156 | 175 | 13225 | 13244 | TTGAGGATAATTCCACAGGG | 21 | 1065 |
| 1101355 | 157 | 176 | 13226 | 13245 | ATTGAGGATAATTCCACAGG | 46 | 1066 |
| 1101356 | 158 | 177 | 13227 | 13246 | AATTGAGGATAATTCCACAG | 53 | 1067 |
| 1101357 | 183 | 202 | 13252 | 13271 | TCTCCTCCTCATCCAGCTGA | 54 | 1068 |
| 1101358 | 184 | 203 | 13253 | 13272 | CTCTCCTCCTCATCCAGCTG | 83 | 1069 |
| 1101359 | 186 | 205 | 13255 | 13274 | TCCTCTCCTCCTCATCCAGC | 28 | 1070 |
| 1101360 | 187 | 206 | 13256 | 13275 | ATCCTCTCCTCCTCATCCAG | 44 | 1071 |
| 1101361 | 189 | 208 | 13258 | 13277 | TCATCCTCTCCTCCTCATCC | 41 | 1072 |
| 1101362 | 193 | 212 | 13262 | 13281 | ATTCTCATCCTCTCCTCCTC | 37 | 1073 |
| 1101363 | 194 | 213 | 13263 | 13282 | CATTCTCATCCTCTCCTCCT | 49 | 1074 |
| 1101364 | 197 | 216 | 13266 | 13285 | TGCCATTCTCATCCTCTCCT | 15 | 1075 |
| 1101365 | 198 | 217 | 13267 | 13286 | CTGCCATTCTCATCCTCTCC | 26 | 1076 |
| 1101367 | 211 | 230 | 13280 | 13299 | GTAACTCCTCCTTCTGCCAT | 31 | 1077 |
| 1101369 | 214 | 233 | 13283 | 13302 | CTAGTAACTCCTCCTTCTGC | 35 | 1078 |
| 1101370 | 215 | 234 | 13284 | 13303 | ACTAGTAACTCCTCCTTCTG | 22 | 1079 |
| 1101371 | 217 | 236 | 13286 | 13305 | TCACTAGTAACTCCTCCTTC | 75 | 1080 |
| 1101372 | 218 | 237 | 13287 | 13306 | TTCACTAGTAACTCCTCCTT | 69 | 1081 |
| 1101373 | 220 | 239 | 13289 | 13308 | TCTTCACTAGTAACTCCTCC | 67 | 1082 |
| 1101374 | 225 | 244 | 13294 | 13313 | GATAATCTTCACTAGTAACT | 66 | 1083 |
| 1101375 | 227 | 246 | 13296 | 13315 | GCGATAATCTTCACTAGTAA | 35 | 1084 |
| 1101376 | 228 | 247 | 13297 | 13316 | TGCGATAATCTTCACTAGTA | 60 | 1085 |
| 1101377 | 229 | 248 | 13298 | 13317 | GTGCGATAATCTTCACTAGT | 97 | 1086 |
| 1101378 | 230 | 249 | 13299 | 13318 | CGTGCGATAATCTTCACTAG | 74 | 1087 |
| 1101379 | 248 | 267 | N/A | N/A | AGAAGGCTGCTGTAAAAACG | 44 | 1088 |
| 1101380 | 249 | 268 | N/A | N/A | CAGAAGGCTGCTGTAAAAAC | 51 | 1089 |
| 1101381 | 251 | 270 | N/A | N/A | TCCAGAAGGCTGCTGTAAAA | 51 | 1090 |
| 1101382 | 258 | 277 | 13863 | 13882 | CCATATTTCCAGAAGGCTGC | 35 | 1091 |
| 1101383 | 259 | 278 | 13864 | 13883 | TCCATATTTCCAGAAGGCTG | 21 | 1092 |
| 1101384 | 260 | 279 | 13865 | 13884 | ATCCATATTTCCAGAAGGCT | 15 | 1093 |
| 1101385 | 261 | 280 | 13866 | 13885 | CATCCATATTTCCAGAAGGC | 26 | 1094 |
| 1101386 | 262 | 281 | 13867 | 13886 | TCATCCATATTTCCAGAAGG | 56 | 1095 |
| 1101387 | 263 | 282 | 13868 | 13887 | GTCATCCATATTTCCAGAAG | 31 | 1096 |
| 1101388 | 266 | 285 | 13871 | 13890 | ACTGTCATCCATATTTCCAG | 23 | 1097 |
| 1101389 | 267 | 286 | 13872 | 13891 | CACTGTCATCCATATTTCCA | 61 | 1098 |
| 1101390 | 270 | 289 | 13875 | 13894 | AACCACTGTCATCCATATTT | 56 | 1099 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101391 | 275 | 294 | 13880 | 13899 | GAAAAAACCACTGTCATCCA | 40 | 1100 |
| 1101392 | 276 | 295 | 13881 | 13900 | AGAAAAAACCACTGTCATCC | 60 | 1101 |
| 1101393 | 278 | 297 | 13883 | 13902 | AGAGAAAAAACCACTGTCAT | 66 | 1102 |
| 1101394 | 279 | 298 | 13884 | 13903 | TAGAGAAAAAACCACTGTCA | 64 | 1103 |
| 1101395 | 281 | 300 | 13886 | 13905 | AATAGAGAAAAACCACTGT | 83 | 1104 |
| 1101396 | 282 | 301 | 13887 | 13906 | GAATAGAGAAAAACCACTG | 62 | 1105 |
| 1101397 | 283 | 302 | 13888 | 13907 | TGAATAGAGAAAAACCACT | 68 | 1106 |
| 1101398 | 284 | 303 | 13889 | 13908 | CTGAATAGAGAAAAACCAC | 115 | 1107 |
| 1101405 | 291 | 310 | N/A | N/A | TTATAACCTGAATAGAGAAA | 111 | 1108 |
| 1101406 | 293 | 312 | N/A | N/A | GCTTATAACCTGAATAGAGA | 39 | 1109 |
| 1101407 | 294 | 313 | N/A | N/A | TGCTTATAACCTGAATAGAG | 41 | 1110 |
| 1101408 | 295 | 314 | N/A | N/A | TTGCTTATAACCTGAATAGA | 57 | 1111 |
| 1101409 | 296 | 315 | N/A | N/A | ATTGCTTATAACCTGAATAG | 63 | 1112 |
| 1101410 | 298 | 317 | N/A | N/A | GCATTGCTTATAACCTGAAT | 43 | 1113 |
| 1101411 | 299 | 318 | N/A | N/A | GGCATTGCTTATAACCTGAA | 11 | 1114 |
| 1101412 | N/A | N/A | 51448 | 51467 | CACAAATTCAAAAGGAAATA | 109 | 1115 |
| 1101413 | N/A | N/A | 51449 | 51468 | ACACAAATTCAAAAGGAAAT | 83 | 1116 |
| 1101414 | N/A | N/A | 51451 | 51470 | AAACACAAATTCAAAAGGAA | 92 | 1117 |
| 1101415 | N/A | N/A | 51452 | 51471 | TAAACACAAATTCAAAAGGA | 91 | 1118 |
| 1101416 | N/A | N/A | 51459 | 51478 | TTAACAATAAACACAAATTC | 79 | 1119 |
| 1101417 | N/A | N/A | 51464 | 51483 | ATGAATTAACAATAAACACA | 155 | 1120 |
| 1101418 | N/A | N/A | 51465 | 51484 | TATGAATTAACAATAAACAC | 101 | 1121 |
| 1101419 | N/A | N/A | 51466 | 51485 | CTATGAATTAACAATAAACA | 107 | 1122 |
| 1101420 | N/A | N/A | 51469 | 51488 | TAGCTATGAATTAACAATAA | 99 | 1123 |
| 1101421 | N/A | N/A | 51471 | 51490 | AATAGCTATGAATTAACAAT | 70 | 1124 |
| 1101422 | N/A | N/A | 51857 | 51876 | AATAGAATATCAATGGACTG | 65 | 1125 |
| 1101423 | N/A | N/A | 51860 | 51879 | TGGAATAGAATATCAATGGA | 54 | 1126 |
| 1101424 | N/A | N/A | 51862 | 51881 | GCTGGAATAGAATATCAATG | 52 | 1127 |
| 1101425 | N/A | N/A | 51943 | 51962 | TCAAATAAAAATTTGGAATT | 108 | 1128 |
| 1101426 | N/A | N/A | 51944 | 51963 | TTCAAATAAAAATTTGGAAT | 82 | 1129 |
| 1101427 | N/A | N/A | 52274 | 52293 | TCCTCAATCAGTCTAGGTGG | 89 | 1130 |
| 1101428 | N/A | N/A | 52275 | 52294 | TTCCTCAATCAGTCTAGGTG | 92 | 1131 |
| 1101429 | N/A | N/A | 52281 | 52300 | AATATATTCCTCAATCAGTC | 114 | 1132 |
| 1101430 | N/A | N/A | 52282 | 52301 | CAATATATTCCTCAATCAGT | 90 | 1133 |
| 1101431 | N/A | N/A | 52283 | 52302 | ACAATATATTCCTCAATCAG | 112 | 1134 |
| 1101432 | N/A | N/A | 52338 | 52357 | GTGCCCAATCCTAATTAAAG | 130 | 1135 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101433 | N/A | N/A | 52339 | 52358 | TGTGCCCAATCCTAATTAAA | 97 | 1136 |
| 1101434 | N/A | N/A | 52352 | 52371 | ATGTTTCAAAATTTGTGCCC | 64 | 1137 |
| 1101435 | N/A | N/A | 52354 | 52373 | TTATGTTTCAAAATTTGTGC | 89 | 1138 |
| 1101436 | N/A | N/A | 52355 | 52374 | ATTATGTTTCAAAATTTGTG | 81 | 1139 |
| 1101437 | N/A | N/A | 53333 | 53352 | ACCCTAATACAAGAGACTCT | 110 | 1140 |
| 1101439 | N/A | N/A | 53336 | 53355 | TCTACCCTAATACAAGAGAC | 100 | 1141 |
| 1101441 | N/A | N/A | 53779 | 53798 | CCATGTAGTGACATGTGGCT | 87 | 1142 |
| 1101442 | N/A | N/A | 53929 | 53948 | TTTTGGAAAAAATGGATCTG | 93 | 1143 |
| 1101443 | N/A | N/A | 53930 | 53949 | CTTTTGGAAAAAATGGATCT | 88 | 1144 |
| 1101444 | N/A | N/A | 53931 | 53950 | GCTTTTGGAAAAAATGGATC | 82 | 1145 |
| 1101445 | N/A | N/A | 53944 | 53963 | GAATTCAAACACAGCTTTTG | 90 | 1146 |
| 1101446 | N/A | N/A | 53948 | 53967 | TGCAGAATTCAAACACAGCT | 82 | 1147 |
| 1101447 | N/A | N/A | 53951 | 53970 | CTGTGCAGAATTCAAACACA | 66 | 1148 |
| 1101574 | N/A | N/A | 3683 | 3702 | GCCCATACTCCCTCCCGGCT | 106 | 1149 |
| 1101575 | N/A | N/A | 3690 | 3709 | CGGCCCCGCCCATACTCCCT | 101 | 1150 |
| 1101576 | N/A | N/A | 3740 | 3759 | AGAAGCAAACCCACTGGGCG | 96 | 1151 |
| 1101577 | N/A | N/A | 3885 | 3904 | GAAAAGTTAATTCTGCCAGG | 49 | 1152 |
| 1101578 | N/A | N/A | 3948 | 3967 | ACAAGACCCCAAAGATCTAC | 71 | 1153 |
| 1101579 | N/A | N/A | 4012 | 4031 | AGTGGGCGAGCCAAGGTCTC | 87 | 1154 |
| 1101580 | N/A | N/A | 4093 | 4112 | GTAATAAAAACTCTTGTGAC | 61 | 1155 |
| 1101581 | N/A | N/A | 4109 | 4128 | CAAACCCAAACATCCCGTAA | 135 | 1156 |
| 1101583 | N/A | N/A | 4113 | 4132 | AAACCAAACCCAAACATCCC | 80 | 1157 |
| 1101585 | N/A | N/A | 4128 | 4147 | TGGGAGTACCAAAAGAAACC | 71 | 1158 |
| 1101586 | N/A | N/A | 4165 | 4184 | TACCTAAAAACAAAGCTGGC | 86 | 1159 |
| 1101587 | N/A | N/A | 4166 | 4185 | ATACCTAAAAACAAAGCTGG | 69 | 1160 |
| 1101588 | N/A | N/A | 4168 | 4187 | TAATACCTAAAAACAAAGCT | 90 | 1161 |
| 1101589 | N/A | N/A | 4170 | 4189 | CCTAATACCTAAAAACAAAG | 102 | 1162 |
| 1101590 | N/A | N/A | 4171 | 4190 | TCCTAATACCTAAAAACAAA | 95 | 1163 |
| 1101591 | N/A | N/A | 4172 | 4191 | CTCCTAATACCTAAAAACAA | 81 | 1164 |
| 1101592 | N/A | N/A | 4173 | 4192 | ACTCCTAATACCTAAAAACA | 85 | 1165 |
| 1101593 | N/A | N/A | 4174 | 4193 | CACTCCTAATACCTAAAAAC | 83 | 1166 |
| 1101594 | N/A | N/A | 4175 | 4194 | CCACTCCTAATACCTAAAAA | 117 | 1167 |
| 1101595 | N/A | N/A | 4180 | 4199 | CCAGTCCACTCCTAATACCT | 63 | 1168 |
| 1101596 | N/A | N/A | 4194 | 4213 | ACAACAAAATCATCCCAGTC | 77 | 1169 |
| 1101597 | N/A | N/A | 4195 | 4214 | TACAACAAAATCATCCCAGT | 71 | 1170 |
| 1101598 | N/A | N/A | 4254 | 4273 | AACAGTATCTTCAAGTGCAT | 53 | 1171 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101599 | N/A | N/A | 4255 | 4274 | AAACAGTATCTTCAAGTGCA | 52 | 1172 |
| 1101600 | N/A | N/A | 4277 | 4296 | GAGGAGTTTCTTTACATATC | 13 | 1173 |
| 1101601 | N/A | N/A | 4357 | 4376 | AACATGATACCATGTGCCAA | 27 | 1174 |
| 1101602 | N/A | N/A | 4375 | 4394 | AACACGAAACTATTATGAAA | 88 | 1175 |
| 1101603 | N/A | N/A | 4415 | 4434 | TCCTCCTATTAAATAACAGC | 62 | 1176 |
| 1101604 | N/A | N/A | 4421 | 4440 | CTTTGCTCCTCCTATTAAAT | 55 | 1177 |
| 1101605 | N/A | N/A | 4459 | 4478 | TAAATGATCATTTATAAGTA | 100 | 1178 |
| 1101606 | N/A | N/A | 4481 | 4500 | TGTGAATTTTAAATGTCTGG | 30 | 1179 |
| 1101607 | N/A | N/A | 4482 | 4501 | GTGTGAATTTTAAATGTCTG | 19 | 1180 |
| 1101608 | N/A | N/A | 4483 | 4502 | TGTGTGAATTTTAAATGTCT | 45 | 1181 |
| 1101609 | N/A | N/A | 4484 | 4503 | GTGTGTGAATTTTAAATGTC | 35 | 1182 |
| 1101610 | N/A | N/A | 4728 | 4747 | TCTCCCAAAAACATTACCTG | 179 | 1183 |
| 1101611 | N/A | N/A | 4732 | 4751 | CGTCTCTCCCAAAAACATTA | 88 | 1184 |
| 1101612 | N/A | N/A | 4857 | 4876 | GTACTTAACAATTTGTTCCA | 46 | 1185 |
| 1101613 | N/A | N/A | 4858 | 4877 | TGTACTTAACAATTTGTTCC | 47 | 1186 |
| 1101614 | N/A | N/A | 4864 | 4883 | AAGCATTGTACTTAACAATT | 55 | 1187 |
| 1101615 | N/A | N/A | 4884 | 4903 | GAGATGTTTTCTACAATGAA | 26 | 1188 |
| 1101616 | N/A | N/A | 4903 | 4922 | GCCTATTTCAAAGTTTCCG | 42 | 1189 |
| 1101617 | N/A | N/A | 4904 | 4923 | AGCCTATTTCAAAGTTTCC | 59 | 1190 |
| 1101619 | N/A | N/A | 4949 | 4968 | TAGTGACAACTATACGACTG | 53 | 1191 |
| 1101621 | N/A | N/A | 5009 | 5028 | CCAAGCAACCAAATCTCTAT | 67 | 1192 |
| 1101622 | N/A | N/A | 5351 | 5370 | ATAACAAAATATGGCCGGG | 91 | 1193 |
| 1101623 | N/A | N/A | 5352 | 5371 | AATAACAAAATATGGCCGG | 91 | 1194 |
| 1101624 | N/A | N/A | 5353 | 5372 | TAATAACAAAATATGGCCG | 101 | 1195 |
| 1101625 | N/A | N/A | 5354 | 5373 | TTAATAACAAAATATGGCC | 85 | 1196 |
| 1101626 | N/A | N/A | 5355 | 5374 | ATTAATAACAAAATATGGC | 163 | 1197 |
| 1101627 | N/A | N/A | 5356 | 5375 | AATTAATAACAAAATATGG | 83 | 1198 |
| 1101628 | N/A | N/A | 5363 | 5382 | CTTTGAAAATTAATAACAAA | 115 | 1199 |
| 1101629 | N/A | N/A | 5365 | 5384 | GCCTTTGAAAATTAATAACA | 85 | 1200 |
| 1101630 | N/A | N/A | 5378 | 5397 | GTCCCACACCAAAGCCTTTG | 73 | 1201 |
| 1101631 | N/A | N/A | 5452 | 5471 | ATATTGTTAAAAATCTTGTC | 72 | 1202 |
| 1101632 | N/A | N/A | 5454 | 5473 | CAATATTGTTAAAAATCTTG | 79 | 1203 |
| 1101633 | N/A | N/A | 5959 | 5978 | AAAAACTAAATTGTTGAATC | 98 | 1204 |
| 1101634 | N/A | N/A | 5962 | 5981 | CCAAAAAACTAAATTGTTGA | 77 | 1205 |
| 1101635 | N/A | N/A | 5964 | 5983 | GCCCAAAAAACTAAATTGTT | 98 | 1206 |
| 1101636 | N/A | N/A | 5965 | 5984 | CGCCCAAAAAACTAAATTGT | 87 | 1207 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101637 | N/A | N/A | 6050 | 6069 | CACAGTAAGCCCAAACATTC | 85 | 1208 |
| 1101638 | N/A | N/A | 6102 | 6121 | AGCAAGGGTTAAAGGTATAT | 68 | 1209 |
| 1101639 | N/A | N/A | 6121 | 6140 | CTCTCCAAACCCAGGACCTA | 115 | 1210 |
| 1101640 | N/A | N/A | 6147 | 6166 | CTTTAGGGCCAAAGTTGGTT | 70 | 1211 |
| 1101641 | N/A | N/A | 6156 | 6175 | ACACAGCTTCTTTAGGGCCA | 56 | 1212 |
| 1101642 | N/A | N/A | 6212 | 6231 | CCAAGGTTCCAAGAGGAAAT | 60 | 1213 |
| 1101643 | N/A | N/A | 6221 | 6240 | AAGAGGAAACCAAGGTTCCA | 94 | 1214 |
| 1101644 | N/A | N/A | 6247 | 6266 | AAGGGTACTCAAAGTGACTA | 69 | 1215 |
| 1101645 | N/A | N/A | 6264 | 6283 | TACATTCTAACTTAATAAAG | 93 | 1216 |
| 1101646 | N/A | N/A | 6269 | 6288 | GTTTTTACATTCTAACTTAA | 65 | 1217 |
| 1101647 | N/A | N/A | 6274 | 6293 | AAACTGTTTTTACATTCTAA | 64 | 1218 |
| 1101648 | N/A | N/A | 6275 | 6294 | GAAACTGTTTTTACATTCTA | 58 | 1219 |
| 1101649 | N/A | N/A | 6348 | 6367 | GCCCCATTCAAATATTTATT | 137 | 1220 |
| 1101650 | N/A | N/A | 6558 | 6577 | TCCATTCAAATATATACATT | 74 | 1221 |
| 1101651 | N/A | N/A | 6561 | 6580 | TTATCCATTCAAATATATAC | 90 | 1222 |
| 1101652 | N/A | N/A | 6565 | 6584 | CTCTTTATCCATTCAAATAT | 70 | 1223 |
| 1101653 | N/A | N/A | 6566 | 6585 | TCTCTTTATCCATTCAAATA | 79 | 1224 |
| 1101655 | N/A | N/A | 6593 | 6612 | CATATATATCTCAGAAACTC | 62 | 1225 |
| 1101657 | N/A | N/A | 6597 | 6616 | GCACCATATATATCTCAGAA | 15 | 1226 |
| 1101658 | N/A | N/A | 6598 | 6617 | AGCACCATATATATCTCAGA | 25 | 1227 |
| 1101659 | N/A | N/A | 6599 | 6618 | CAGCACCATATATATCTCAG | 21 | 1228 |
| 1101660 | N/A | N/A | 6601 | 6620 | AACAGCACCATATATATCTC | 54 | 1229 |
| 1101661 | N/A | N/A | 6610 | 6629 | CTTTAGATAAACAGCACCAT | 66 | 1230 |
| 1101662 | N/A | N/A | 6614 | 6633 | TTTACTTTAGATAAACAGCA | 56 | 1231 |
| 1101663 | N/A | N/A | 6639 | 6658 | CCTTAAAATATTTACAGAAA | 78 | 1232 |
| 1101664 | N/A | N/A | 6648 | 6667 | CCTGCAAAGCCTTAAAATAT | 92 | 1233 |
| 1101665 | N/A | N/A | 6667 | 6686 | TGACAGAGACTACAGCTGGC | 85 | 1234 |
| 1101666 | N/A | N/A | 6698 | 6717 | GTTGGGAAAAACATGCACAA | 43 | 1235 |
| 1101667 | N/A | N/A | 6700 | 6719 | TGGTTGGGAAAAACATGCAC | 34 | 1236 |
| 1101668 | N/A | N/A | 6716 | 6735 | ACTTTACATTTTTACATGGT | 25 | 1237 |
| 1101669 | N/A | N/A | 6731 | 6750 | AGTAGCTAAGAATGCACTTT | 74 | 1238 |
| 1101670 | N/A | N/A | 6754 | 6773 | ATGGGCCAAATTCAACCTGC | 90 | 1239 |
| 1101671 | N/A | N/A | 6824 | 6843 | CAACAAAAATCCAGTAGTGG | 68 | 1240 |
| 1101672 | N/A | N/A | 6825 | 6844 | ACAACAAAAATCCAGTAGTG | 68 | 1241 |
| 1101673 | N/A | N/A | 6842 | 6861 | CAGAACTAAAACAAACAACA | 78 | 1242 |
| 1101674 | N/A | N/A | 6844 | 6863 | ACCAGAACTAAAACAAACAA | 92 | 1243 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101675 | N/A | N/A | 6845 | 6864 | CACCAGAACTAAAACAAACA | 106 | 1244 |
| 1101676 | N/A | N/A | 6847 | 6866 | GGCACCAGAACTAAAACAAA | 67 | 1245 |
| 1101677 | N/A | N/A | 6851 | 6870 | AGCAGGCACCAGAACTAAAA | 74 | 1246 |
| 1101678 | N/A | N/A | 6903 | 6922 | TAACTGCACCAAGAAACATC | 93 | 1247 |
| 1101679 | N/A | N/A | 6924 | 6943 | GCACCAATACAAATGGCACA | 60 | 1248 |
| 1101680 | N/A | N/A | 6926 | 6945 | AAGCACCAATACAAATGGCA | 69 | 1249 |
| 1101681 | N/A | N/A | 6941 | 6960 | TTTGCATTACATTAAAAGCA | 64 | 1250 |
| 1101682 | N/A | N/A | 6955 | 6974 | GATATTATTACCAGTTTGCA | 17 | 1251 |
| 1101683 | N/A | N/A | 6977 | 6996 | ATGTACAACCCCAGCAAGTT | 41 | 1252 |
| 1101684 | N/A | N/A | 6978 | 6997 | TATGTACAACCCCAGCAAGT | 73 | 1253 |
| 1101685 | N/A | N/A | 6989 | 7008 | TTCAATAATTTTATGTACAA | 95 | 1254 |
| 1101686 | N/A | N/A | 7037 | 7056 | GGGCATAATGAATGCCACAG | 75 | 1255 |
| 1101687 | N/A | N/A | 7062 | 7081 | TGGCTAAAATCCAGCAATCA | 68 | 1256 |
| 1101688 | N/A | N/A | 7093 | 7112 | GGCTTCTCCTAAAGCTCAAA | 73 | 1257 |
| 1101689 | N/A | N/A | 7110 | 7129 | TCATTTATACAGAATTTGGC | 21 | 1258 |
| 1101691 | N/A | N/A | 7120 | 7139 | GCACTTCAAGTCATTTATAC | 57 | 1259 |
| 1101693 | N/A | N/A | 7304 | 7323 | ACTATCTGCCAGGGAGCCTT | 76 | 1260 |
| 1101694 | N/A | N/A | 7328 | 7347 | GGCAATGGCCAGTACTTCTA | 79 | 1261 |
| 1101695 | N/A | N/A | 7377 | 7396 | TCTCCGAGCCCTTACTATGA | 74 | 1262 |
| 1101696 | N/A | N/A | 7462 | 7481 | AGGTATAAACCTAAGGTGCT | 58 | 1263 |
| 1101697 | N/A | N/A | 7474 | 7493 | ACAACACAAATCAGGTATAA | 93 | 1264 |
| 1101698 | N/A | N/A | 7477 | 7496 | ACTACAACACAAATCAGGTA | 80 | 1265 |
| 1101699 | N/A | N/A | 7479 | 7498 | TAACTACAACACAAATCAGG | 73 | 1266 |
| 1101700 | N/A | N/A | 7485 | 7504 | CACTACTAACTACAACACAA | 70 | 1267 |
| 1101701 | N/A | N/A | 7486 | 7505 | ACACTACTAACTACAACACA | 91 | 1268 |
| 1101702 | N/A | N/A | 7491 | 7510 | CAGAGACACTACTAACTACA | 66 | 1269 |
| 1101703 | N/A | N/A | 7502 | 7521 | GTTCAAATTACCAGAGACAC | 75 | 1270 |
| 1101704 | N/A | N/A | 7504 | 7523 | TAGTTCAAATTACCAGAGAC | 60 | 1271 |
| 1101705 | N/A | N/A | 7505 | 7524 | CTAGTTCAAATTACCAGAGA | 66 | 1272 |
| 1101706 | N/A | N/A | 7508 | 7527 | AAACTAGTTCAAATTACCAG | 84 | 1273 |
| 1101707 | N/A | N/A | 7521 | 7540 | CAAGACCAACCTGAAACTAG | 70 | 1274 |
| 1101708 | N/A | N/A | 7526 | 7545 | GTTTTCAAGACCAACCTGAA | 108 | 1275 |
| 1101709 | N/A | N/A | 7549 | 7568 | TCATTTACCCCCAACCTCCC | 78 | 1276 |
| 1101710 | N/A | N/A | 7552 | 7571 | AAATCATTTACCCCCAACCT | 81 | 1277 |
| 1101711 | N/A | N/A | 7556 | 7575 | TACCAAATCATTTACCCCCA | 53 | 1278 |
| 1101712 | N/A | N/A | 7558 | 7577 | GCTACCAAATCATTTACCCC | 82 | 1279 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101713 | N/A | N/A | 7559 | 7578 | TGCTACCAAATCATTTACCC | 80 | 1280 |
| 1101714 | N/A | N/A | 7562 | 7581 | AACTGCTACCAAATCATTTA | 53 | 1281 |
| 1101715 | N/A | N/A | 7600 | 7619 | GCAGTTCTACAAAGATAATG | 46 | 1282 |
| 1101716 | N/A | N/A | 8424 | 8443 | ATTGAAATCTCATGATTTGG | 92 | 1283 |
| 1101717 | N/A | N/A | 8425 | 8444 | TATTGAAATCTCATGATTTG | 86 | 1284 |
| 1101718 | N/A | N/A | 8447 | 8466 | TGCCATAATCAAAGTTCAGC | 29 | 1285 |
| 1101719 | N/A | N/A | 8449 | 8468 | TTTGCCATAATCAAAGTTCA | 69 | 1286 |
| 1101720 | N/A | N/A | 8453 | 8472 | TCACTTTGCCATAATCAAAG | 52 | 1287 |
| 1101721 | N/A | N/A | 8455 | 8474 | GTTCACTTTGCCATAATCAA | 26 | 1288 |
| 1101722 | N/A | N/A | 8474 | 8493 | AGCTTTAATCAAAGCAGAAG | 86 | 1289 |
| 1101723 | N/A | N/A | 8477 | 8496 | TCAAGCTTTAATCAAAGCAG | 106 | 1290 |
| 1101724 | N/A | N/A | 8504 | 8523 | TCAAACTATCCCCAGCCACC | 107 | 1291 |
| 1101725 | N/A | N/A | 8508 | 8527 | TATCTCAAACTATCCCCAGC | 108 | 1292 |
| 1101727 | N/A | N/A | 8510 | 8529 | CTTATCTCAAACTATCCCCA | 123 | 1293 |
| 1101729 | N/A | N/A | 8514 | 8533 | TGCCCTTATCTCAAACTATC | 104 | 1294 |
| 1101730 | N/A | N/A | 8520 | 8539 | CTGCCTTGCCCTTATCTCAA | 79 | 1295 |
| 1101731 | N/A | N/A | 8531 | 8550 | TATGCATTTTCCTGCCTTGC | 71 | 1296 |
| 1101732 | N/A | N/A | 8571 | 8590 | ACCAAAAGAATTGTACAATG | 85 | 1297 |
| 1101733 | N/A | N/A | 8573 | 8592 | GGACCAAAAGAATTGTACAA | 106 | 1298 |
| 1101734 | N/A | N/A | 8578 | 8597 | CACATGGACCAAAAGAATTG | 114 | 1299 |
| 1101735 | N/A | N/A | 8591 | 8610 | ACGGATCAAATTCCACATGG | 51 | 1300 |
| 1101736 | N/A | N/A | 8785 | 8804 | TGGTTCATACTATAATCTCA | 26 | 1301 |
| 1101737 | N/A | N/A | 8823 | 8842 | TCAGTACAAATTTAAAAATC | 81 | 1302 |
| 1101738 | N/A | N/A | 8826 | 8845 | TGTTCAGTACAAATTTAAAA | 76 | 1303 |
| 1101739 | N/A | N/A | 8831 | 8850 | CAAACTGTTCAGTACAAATT | 71 | 1304 |
| 1101740 | N/A | N/A | 8837 | 8856 | AAAGGACAAACTGTTCAGTA | 35 | 1305 |
| 1101741 | N/A | N/A | 8860 | 8879 | TTCTAATATGATTTAATGGA | 94 | 1306 |
| 1101742 | N/A | N/A | 8861 | 8880 | CTTCTAATATGATTTAATGG | 62 | 1307 |
| 1101743 | N/A | N/A | 8882 | 8901 | CAGGAAATATCAAGTTCTGT | 47 | 1308 |
| 1101744 | N/A | N/A | 8883 | 8902 | ACAGGAAATATCAAGTTCTG | 81 | 1309 |
| 1101745 | N/A | N/A | 8903 | 8922 | CAAAGAAAAACTGTATTGCT | 53 | 1310 |
| 1101746 | N/A | N/A | 8917 | 8936 | AAATCAAACTTCATCAAAGA | 90 | 1311 |
| 1101747 | N/A | N/A | 8918 | 8937 | GAAATCAAACTTCATCAAAG | 52 | 1312 |
| 1101748 | N/A | N/A | 8919 | 8938 | TGAAATCAAACTTCATCAAA | 86 | 1313 |
| 1101749 | N/A | N/A | 8922 | 8941 | ACTTGAAATCAAACTTCATC | 57 | 1314 |
| 1101750 | N/A | N/A | 8947 | 8966 | TAGCTTTAAATTATGAAAAA | 97 | 1315 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101751 | N/A | N/A | 8948 | 8967 | ATAGCTTTAAATTATGAAAA | 64 | 1316 |
| 1101752 | N/A | N/A | 8950 | 8969 | AAATAGCTTTAAATTATGAA | 99 | 1317 |
| 1101753 | N/A | N/A | 8959 | 8978 | CTCTATAAAAAATAGCTTTA | 103 | 1318 |
| 1101754 | N/A | N/A | 8973 | 8992 | TTGATTAAAATTCTCTCTAT | 97 | 1319 |
| 1101755 | N/A | N/A | 8986 | 9005 | GACATCCAAATATTTGATTA | 33 | 1320 |
| 1101756 | N/A | N/A | 8989 | 9008 | AGTGACATCCAAATATTTGA | 49 | 1321 |
| 1101757 | N/A | N/A | 9010 | 9029 | CTTAATACCATATATAGCAA | 71 | 1322 |
| 1101758 | N/A | N/A | 9012 | 9031 | TACTTAATACCATATATAGC | 73 | 1323 |
| 1101759 | N/A | N/A | 9013 | 9032 | ATACTTAATACCATATATAG | 115 | 1324 |
| 1101760 | N/A | N/A | 9023 | 9042 | TATGGTCACCATACTTAATA | 66 | 1325 |
| 1101761 | N/A | N/A | 9033 | 9052 | GTTTACAAACTATGGTCACC | 78 | 1326 |
| 1101763 | N/A | N/A | 9035 | 9054 | GAGTTTACAAACTATGGTCA | 58 | 1327 |
| 1101765 | N/A | N/A | 9064 | 9083 | CACAAATTTCCTGTCTTGCT | 59 | 1328 |
| 1101766 | N/A | N/A | 9068 | 9087 | CTAACACAAATTTCCTGTCT | 62 | 1329 |
| 1101767 | N/A | N/A | 9071 | 9090 | TTGCTAACACAAATTTCCTG | 73 | 1330 |
| 1101768 | N/A | N/A | 9073 | 9092 | CTTTGCTAACACAAATTTCC | 77 | 1331 |
| 1101769 | N/A | N/A | 9083 | 9102 | AGAAAAAAGCCTTTGCTAAC | 95 | 1332 |
| 1101770 | N/A | N/A | 9101 | 9120 | TAAAAAATTCAAACAGTAAG | 86 | 1333 |
| 1101771 | N/A | N/A | 9319 | 9338 | TCAGGCAAAACTCATTTATG | 44 | 1334 |
| 1101772 | N/A | N/A | 9340 | 9359 | TCCAGTCACAAAAGCTCAAA | 65 | 1335 |
| 1101773 | N/A | N/A | 9341 | 9360 | TTCCAGTCACAAAAGCTCAA | 92 | 1336 |
| 1101774 | N/A | N/A | 9389 | 9408 | ATGGTAAACTAAAGAGGACA | 88 | 1337 |
| 1101775 | N/A | N/A | 9392 | 9411 | ACAATGGTAAACTAAAGAGG | 63 | 1338 |
| 1101776 | N/A | N/A | 9400 | 9419 | TTTCTCAAACAATGGTAAAC | 50 | 1339 |
| 1101777 | N/A | N/A | 9406 | 9425 | GATAAATTTCTCAAACAATG | 102 | 1340 |
| 1101778 | N/A | N/A | 9447 | 9466 | AATTAACAATAATTAACAGT | 79 | 1341 |
| 1101779 | N/A | N/A | 9450 | 9469 | GTTAATTAACAATAATTAAC | 103 | 1342 |
| 1101780 | N/A | N/A | 9470 | 9489 | ATGAATTAACTACAACAGTA | 118 | 1343 |
| 1101781 | N/A | N/A | 9500 | 9519 | CTCACAAAAGAATACTAGAT | 61 | 1344 |
| 1101782 | N/A | N/A | 9507 | 9526 | GTGTTTACTCACAAAAGAAT | 65 | 1345 |
| 1101783 | N/A | N/A | 9552 | 9571 | GAAACGACCCAAATGGATAG | 75 | 1346 |
| 1101784 | N/A | N/A | 9554 | 9573 | TGGAAACGACCCAAATGGAT | 80 | 1347 |
| 1101785 | N/A | N/A | 9585 | 9604 | ATAGCATTACTATTTGTAAT | 68 | 1348 |
| 1101786 | N/A | N/A | 9597 | 9616 | ATAGCATTACAGATAGCATT | 40 | 1349 |
| 1101787 | N/A | N/A | 9610 | 9629 | GTAGTAATACAAAATAGCAT | 85 | 1350 |
| 1101788 | N/A | N/A | 9625 | 9644 | ATAGCATTACTATTTGTAGT | 68 | 1351 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101789 | N/A | N/A | 9746 | 9765 | ATCTCCTATGATCTAGCAAT | 68 | 1352 |
| 1101790 | N/A | N/A | 9761 | 9780 | AAGCTTAATATATACATCTC | 81 | 1353 |
| 1101791 | N/A | N/A | 9763 | 9782 | TAAAGCTTAATATATACATC | 115 | 1354 |
| 1101792 | N/A | N/A | 9788 | 9807 | ACTAATAATTATGTAATGCA | 98 | 1355 |
| 1101793 | N/A | N/A | 9790 | 9809 | TAACTAATAATTATGTAATG | 126 | 1356 |
| 1101794 | N/A | N/A | 9791 | 9810 | ATAACTAATAATTATGTAAT | 84 | 1357 |
| 1101795 | N/A | N/A | 9792 | 9811 | AATAACTAATAATTATGTAA | 109 | 1358 |
| 1101796 | N/A | N/A | 9797 | 9816 | CCAATAATAACTAATAATTA | 88 | 1359 |
| 1101797 | N/A | N/A | 9798 | 9817 | ACCAATAATAACTAATAATT | 111 | 1360 |
| 1101799 | N/A | N/A | 9806 | 9825 | TTGGTATAACCAATAATAAC | 85 | 1361 |
| 1101801 | N/A | N/A | 9882 | 9901 | CACAAACTCTAAAATGGCTA | 72 | 1362 |
| 1101802 | N/A | N/A | 9997 | 10016 | GGCAAGACAAACAAGCACTT | 77 | 1363 |
| 1101803 | N/A | N/A | 10199 | 10218 | CTTGAGCCCCAAAAGGTCG | 93 | 1364 |
| 1101804 | N/A | N/A | 10409 | 10428 | TGAAAAATAGCCAAGGCTGG | 96 | 1365 |
| 1101805 | N/A | N/A | 10424 | 10443 | CTACTTATATCCTTTTGAAA | 65 | 1366 |
| 1101806 | N/A | N/A | 10439 | 10458 | GGATATACAGATGTTCTACT | 25 | 1367 |
| 1101807 | N/A | N/A | 10441 | 10460 | AGGGATATACAGATGTTCTA | 39 | 1368 |
| 1101808 | N/A | N/A | 10443 | 10462 | GAAGGGATATACAGATGTTC | 27 | 1369 |
| 1101809 | N/A | N/A | 10463 | 10482 | TACTGAATAATATGCAAATT | 99 | 1370 |
| 1101810 | N/A | N/A | 10468 | 10487 | ACTCTTACTGAATAATATGC | 75 | 1371 |
| 1101811 | N/A | N/A | 10489 | 10508 | TATTTCTACTACCAGAGTGC | 38 | 1372 |
| 1101812 | N/A | N/A | 10505 | 10524 | CTTTCTCCTCCTTATATATT | 67 | 1373 |
| 1101813 | N/A | N/A | 10605 | 10624 | AAGTTTATCTTCAACTTTTC | 59 | 1374 |
| 1101814 | N/A | N/A | 10606 | 10625 | TAAGTTTATCTTCAACTTTT | 101 | 1375 |
| 1101815 | N/A | N/A | 10676 | 10695 | GTGAAAAAAATATGGGTTAT | 55 | 1376 |
| 1101816 | N/A | N/A | 10677 | 10696 | GGTGAAAAAAATATGGGTTA | 37 | 1377 |
| 1101817 | N/A | N/A | 10678 | 10697 | TGGTGAAAAAAATATGGGTT | 21 | 1378 |
| 1101818 | N/A | N/A | 10679 | 10698 | CTGGTGAAAAAAATATGGGT | 57 | 1379 |
| 1101819 | N/A | N/A | 10681 | 10700 | AGCTGGTGAAAAAAATATGG | 90 | 1380 |
| 1101820 | N/A | N/A | 10683 | 10702 | TCAGCTGGTGAAAAAAATAT | 93 | 1381 |
| 1101821 | N/A | N/A | 10694 | 10713 | AGGAGCAAAATTCAGCTGGT | 49 | 1382 |
| 1101822 | N/A | N/A | 10745 | 10764 | AAAGAGAACCACCTTGCAAG | 87 | 1383 |
| 1101823 | N/A | N/A | 10747 | 10766 | CTAAAGAGAACCACCTTGCA | 68 | 1384 |
| 1101824 | N/A | N/A | 10809 | 10828 | TTCCTTAACCCAACCTATCT | 107 | 1385 |
| 1101825 | N/A | N/A | 10810 | 10829 | ATTCCTTAACCCAACCTATC | 80 | 1386 |
| 1101826 | N/A | N/A | 10815 | 10834 | GGTCTATTCCTTAACCCAAC | 53 | 1387 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101827 | N/A | N/A | 10816 | 10835 | AGGTCTATTCCTTAACCCAA | 77 | 1388 |
| 1101828 | N/A | N/A | 10817 | 10836 | AAGGTCTATTCCTTAACCCA | 42 | 1389 |
| 1101829 | N/A | N/A | 10833 | 10852 | TCTCTCTTTCCCCAATAAGG | 75 | 1390 |
| 1101830 | N/A | N/A | 10872 | 10891 | AGAACATTTCCTTCTCCTGC | 66 | 1391 |
| 1101831 | N/A | N/A | 11044 | 11063 | TGAATCCAAGTCCAGGGTGC | 79 | 1392 |
| 1101832 | N/A | N/A | 11071 | 11090 | GGGCAGTTTCTCACACAACT | 48 | 1393 |
| 1101833 | N/A | N/A | 11185 | 11204 | CCTGGACAAGCCAGCAAGAG | 110 | 1394 |
| 1101835 | N/A | N/A | 11215 | 11234 | GAACTGTCCCAAACAACCCT | 66 | 1395 |
| 1101837 | N/A | N/A | 11258 | 11277 | GGAACTCTACAGATAATGTA | 66 | 1396 |
| 1101838 | N/A | N/A | 11303 | 11322 | GTTCCATGTTAAAACTTGCA | 146 | 1397 |
| 1101839 | N/A | N/A | 11308 | 11327 | ATTCTGTTCCATGTTAAAAC | 103 | 1398 |
| 1101840 | N/A | N/A | 11317 | 11336 | GTGAGAAAAATTCTGTTCCA | 55 | 1399 |
| 1101841 | N/A | N/A | 11320 | 11339 | CAGGTGAGAAAAATTCTGTT | 126 | 1400 |
| 1101842 | N/A | N/A | 11370 | 11389 | CACACAATCTAAATGCTTGT | 102 | 1401 |
| 1101843 | N/A | N/A | 11703 | 11722 | CATTTATTCTTTTAACATGA | 86 | 1402 |
| 1101844 | N/A | N/A | 11707 | 11726 | AGAACATTTATTCTTTTAAC | 106 | 1403 |
| 1101845 | N/A | N/A | 11711 | 11730 | CCCTAGAACATTTATTCTTT | 88 | 1404 |
| 1101846 | N/A | N/A | 11870 | 11889 | GAAAGGAAATTTTAGTCCCT | 48 | 1405 |
| 1101847 | N/A | N/A | 11879 | 11898 | ACTAATGGTGAAAGGAAATT | 89 | 1406 |
| 1101848 | N/A | N/A | 11887 | 11906 | AGTAAATTACTAATGGTGAA | 51 | 1407 |
| 1101849 | N/A | N/A | 11888 | 11907 | CAGTAAATTACTAATGGTGA | 63 | 1408 |
| 1101850 | N/A | N/A | 11889 | 11908 | ACAGTAAATTACTAATGGTG | 59 | 1409 |
| 1101851 | N/A | N/A | 11890 | 11909 | TACAGTAAATTACTAATGGT | 86 | 1410 |
| 1101852 | N/A | N/A | 11925 | 11944 | TTCAGTACCTAAAATAAGTT | 86 | 1411 |
| 1101853 | N/A | N/A | 11933 | 11952 | CCCTCATTTTCAGTACCTAA | 36 | 1412 |
| 1101854 | N/A | N/A | 11951 | 11970 | GTATAAAACATTTAGTCTCC | 49 | 1413 |
| 1101855 | N/A | N/A | 11952 | 11971 | TGTATAAAACATTTAGTCTC | 70 | 1414 |
| 1101856 | N/A | N/A | 11953 | 11972 | CTGTATAAAACATTTAGTCT | 82 | 1415 |
| 1101857 | N/A | N/A | 11954 | 11973 | ACTGTATAAAACATTTAGTC | 78 | 1416 |
| 1101858 | N/A | N/A | 11977 | 11996 | AATCTCATATTTTACTAAAA | 127 | 1417 |
| 1101859 | N/A | N/A | 11988 | 12007 | CAAATGCATCAAATCTCATA | 59 | 1418 |
| 1101860 | N/A | N/A | 11997 | 12016 | ATCATCTATCAAATGCATCA | 38 | 1419 |
| 1101861 | N/A | N/A | 12011 | 12030 | TATTTAAACAAACATCATC | 107 | 1420 |
| 1101862 | N/A | N/A | 12016 | 12035 | AGAATTATTTAAACAAACA | 102 | 1421 |
| 1101863 | N/A | N/A | 12017 | 12036 | AAGAATTATTTAAACAAAC | 87 | 1422 |
| 1101864 | N/A | N/A | 12027 | 12046 | TCAAAAATTTAAGAATTATT | 80 | 1423 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101865 | N/A | N/A | 12028 | 12047 | ATCAAAAATTTAAGAATTAT | 130 | 1424 |
| 1101866 | N/A | N/A | 12030 | 12049 | TGATCAAAAATTTAAGAATT | 73 | 1425 |
| 1101867 | N/A | N/A | 12031 | 12050 | ATGATCAAAAATTTAAGAAT | 135 | 1426 |
| 1101868 | N/A | N/A | 12032 | 12051 | CATGATCAAAAATTTAAGAA | 87 | 1427 |
| 1101869 | N/A | N/A | 12034 | 12053 | TACATGATCAAAAATTTAAG | 120 | 1428 |
| 1101871 | N/A | N/A | 12050 | 12069 | TTAATGAAACTATAATTACA | 96 | 1429 |
| 1101873 | N/A | N/A | 12092 | 12111 | CATGCATTTTCATTTGGTAA | 21 | 1430 |
| 1101874 | N/A | N/A | 12137 | 12156 | TTGAACTGAACTTTCAGCTT | 60 | 1431 |
| 1101875 | N/A | N/A | 12268 | 12287 | ATACGGTTTCACAATGTTAG | 42 | 1432 |
| 1101876 | N/A | N/A | 12770 | 12789 | CTAAATAATTTAATCATTAA | 91 | 1433 |
| 1101877 | N/A | N/A | 12772 | 12791 | CCCTAAATAATTTAATCATT | 104 | 1434 |
| 1101878 | N/A | N/A | 12774 | 12793 | TCCCCTAAATAATTTAATCA | 128 | 1435 |
| 1101879 | N/A | N/A | 12778 | 12797 | CGGCTCCCCTAAATAATTTA | 81 | 1436 |
| 1101880 | N/A | N/A | 13087 | 13106 | ATCTTCCCCTAAATAATTTT | 82 | 1437 |
| 1101881 | N/A | N/A | 13129 | 13148 | AGAAAAAATTAAAATGTGAC | 106 | 1438 |
| 1101882 | N/A | N/A | 13145 | 13164 | TGCTAATATTTCCAAAAGAA | 75 | 1439 |
| 1101883 | N/A | N/A | 13146 | 13165 | TTGCTAATATTTCCAAAAGA | 61 | 1440 |
| 1101884 | N/A | N/A | 13159 | 13178 | AAAGTGAGCCTTCTTGCTAA | 74 | 1441 |
| 1101885 | N/A | N/A | 13328 | 13347 | AGTGAGTTTAAAATCAGTAC | 76 | 1442 |
| 1101886 | N/A | N/A | 13329 | 13348 | TAGTGAGTTTAAAATCAGTA | 84 | 1443 |
| 1101887 | N/A | N/A | 13664 | 13683 | TATCCACATTTTTAAAAGAA | 91 | 1444 |
| 1101888 | N/A | N/A | 13709 | 13728 | CAGTCAGATCCCTATAGGAA | 31 | 1445 |
| 1101889 | N/A | N/A | 13714 | 13733 | TTCACCAGTCAGATCCCTAT | 50 | 1446 |
| 1101890 | N/A | N/A | 13718 | 13737 | ATAATTCACCAGTCAGATCC | 59 | 1447 |
| 1101891 | N/A | N/A | 13720 | 13739 | TTATAATTCACCAGTCAGAT | 53 | 1448 |
| 1101892 | N/A | N/A | 13721 | 13740 | GTTATAATTCACCAGTCAGA | 44 | 1449 |
| 1101893 | N/A | N/A | 13722 | 13741 | AGTTATAATTCACCAGTCAG | 46 | 1450 |
| 1101894 | N/A | N/A | 13723 | 13742 | CAGTTATAATTCACCAGTCA | 50 | 1451 |
| 1101895 | N/A | N/A | 13724 | 13743 | ACAGTTATAATTCACCAGTC | 47 | 1452 |
| 1101896 | N/A | N/A | 13746 | 13765 | TCCCATTTCCAAAGTTAACA | 62 | 1453 |
| 1101897 | N/A | N/A | 13775 | 13794 | GTGCATATTTAAAACAATAT | 110 | 1454 |
| 1101898 | N/A | N/A | 13796 | 13815 | AGGATACAAACTGTCATTAG | 141 | 1455 |
| 1101899 | N/A | N/A | 13799 | 13818 | AGAAGGATACAAACTGTCAT | 106 | 1456 |
| 1101900 | N/A | N/A | 13844 | 13863 | CTGTTAATTTTGACAGGTAG | 65 | 1457 |
| 1101901 | N/A | N/A | 13847 | 13866 | CTGCTGTTAATTTTGACAGG | 96 | 1458 |
| 1101902 | N/A | N/A | 13899 | 13918 | GACTACTTACCTGAATAGAG | 84 | 1459 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101903 | N/A | N/A | 13904 | 13923 | CTTGTGACTACTTACCTGAA | 97 | 1460 |
| 1101904 | N/A | N/A | 13926 | 13945 | TGTAAGCAACACATAGTACA | 98 | 1461 |
| 1101905 | N/A | N/A | 14015 | 14034 | GAGTATAATCTATACTCTGT | 131 | 1462 |
| 1101907 | N/A | N/A | 14331 | 14350 | TATATAAAATCTAGTACTC | 111 | 1463 |
| 1101909 | N/A | N/A | 14334 | 14353 | ATCTATATAAAAATCTAGTA | 75 | 1464 |
| 1101910 | N/A | N/A | 14335 | 14354 | TATCTATATAAAAATCTAGT | 96 | 1465 |
| 1101911 | N/A | N/A | 14343 | 14362 | TTCATGTTTATCTATATAAA | 82 | 1466 |
| 1101912 | N/A | N/A | 14350 | 14369 | CAATCCTTTCATGTTTATCT | 25 | 1467 |
| 1101913 | N/A | N/A | 14354 | 14373 | TCTACAATCCTTTCATGTTT | 47 | 1468 |
| 1101914 | N/A | N/A | 14355 | 14374 | TTCTACAATCCTTTCATGTT | 43 | 1469 |
| 1101915 | N/A | N/A | 14356 | 14375 | ATTCTACAATCCTTTCATGT | 41 | 1470 |
| 1101916 | N/A | N/A | 14389 | 14408 | AGGAATTTTTAAATGCCCCA | 48 | 1471 |
| 1101917 | N/A | N/A | 14390 | 14409 | AAGGAATTTTTAAATGCCCC | 104 | 1472 |
| 1101918 | N/A | N/A | 14391 | 14410 | GAAGGAATTTTTAAATGCCC | 20 | 1473 |
| 1101919 | N/A | N/A | 14392 | 14411 | AGAAGGAATTTTTAAATGCC | 52 | 1474 |
| 1101920 | N/A | N/A | 14434 | 14453 | TAAGGTTATTATTAGCATCC | 8 | 1475 |
| 1101921 | N/A | N/A | 14436 | 14455 | ATTAAGGTTATTATTAGCAT | 89 | 1476 |
| 1101922 | N/A | N/A | 14792 | 14811 | CTCAAATTTACCCAACAGAT | 96 | 1477 |
| 1101923 | N/A | N/A | 14796 | 14815 | TTTTCTCAAATTTACCCAAC | 77 | 1478 |
| 1101924 | N/A | N/A | 14830 | 14849 | GGCTGATTTAAAAGGATGGT | 48 | 1479 |
| 1101925 | N/A | N/A | 14831 | 14850 | AGGCTGATTTAAAAGGATGG | 57 | 1480 |
| 1101926 | N/A | N/A | 14834 | 14853 | GGTAGGCTGATTTAAAAGGA | 25 | 1481 |
| 1101927 | N/A | N/A | 14849 | 14868 | AAGGAAATCCAGTCTGGTAG | 27 | 1482 |
| 1101928 | N/A | N/A | 14851 | 14870 | ATAAGGAAATCCAGTCTGGT | 78 | 1483 |
| 1101929 | N/A | N/A | 14864 | 14883 | GCCACAAACCATAATAAGGA | 56 | 1484 |
| 1101930 | N/A | N/A | 14873 | 14892 | AAATCAAAAGCCACAAACCA | 73 | 1485 |
| 1101931 | N/A | N/A | 14895 | 14914 | AGAGCTATACATTAAAAAAA | 69 | 1486 |
| 1101932 | N/A | N/A | 14909 | 14928 | CAAAGAATTCAAAGAGAGCT | 89 | 1487 |
| 1101933 | N/A | N/A | 14914 | 14933 | ACCACCAAAGAATTCAAAGA | 119 | 1488 |
| 1101934 | N/A | N/A | 14918 | 14937 | TATAACCACCAAAGAATTCA | 81 | 1489 |
| 1101935 | N/A | N/A | 14921 | 14940 | ATATATAACCACCAAAGAAT | 84 | 1490 |
| 1101936 | N/A | N/A | 14923 | 14942 | ATATATATAACCACCAAAGA | 95 | 1491 |
| 1101937 | N/A | N/A | 14928 | 14947 | TACATATATATAACCACC | 71 | 1492 |
| 1101938 | N/A | N/A | 14930 | 14949 | AGTACATATATATATAACCA | 96 | 1493 |
| 1101939 | N/A | N/A | 14949 | 14968 | CAGATAAAGAATCTTGCGA | 84 | 1494 |
| 1101940 | N/A | N/A | 14972 | 14991 | TTAGAAAAGAATGAAAGAC | 27 | 1495 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101941 | N/A | N/A | 14991 | 15010 | CTGGATACAACTCACAGTGT | 63 | 1496 |
| 1101943 | N/A | N/A | 15141 | 15160 | TGCAGTAGCCATTACCTGTT | 87 | 1497 |
| 1101945 | N/A | N/A | 15217 | 15236 | AACAGGCACCAAGAGCAGCA | 82 | 1498 |
| 1101946 | N/A | N/A | 15292 | 15311 | GGTAGCCAACAAAGAAGCAA | 64 | 1499 |
| 1101947 | N/A | N/A | 15295 | 15314 | CAAGGTAGCCAACAAAGAAG | 85 | 1500 |
| 1101948 | N/A | N/A | 15297 | 15316 | TCCAAGGTAGCCAACAAAGA | 72 | 1501 |
| 1101949 | N/A | N/A | 15318 | 15337 | CTGAAAATTCACTATCTGCC | 67 | 1502 |
| 1101950 | N/A | N/A | 15321 | 15340 | TTTCTGAAAATTCACTATCT | 79 | 1503 |
| 1101951 | N/A | N/A | 15324 | 15343 | AAATTTCTGAAAATTCACTA | 76 | 1504 |
| 1101952 | N/A | N/A | 15367 | 15386 | AAATGCAAACCTGTTTATTT | 68 | 1505 |
| 1101953 | N/A | N/A | 15441 | 15460 | CTGGGCATTTAAACTGAAGG | 72 | 1506 |
| 1101954 | N/A | N/A | 15461 | 15480 | TCTACCAAAATAAGTTCTCC | 99 | 1507 |
| 1101955 | N/A | N/A | 15465 | 15484 | CATATCTACCAAAATAAGTT | 76 | 1508 |
| 1101956 | N/A | N/A | 15503 | 15522 | AAAATTATATTCAACTTGCT | 93 | 1509 |
| 1101957 | N/A | N/A | 15519 | 15538 | TGGGTGCTACTTTAGAAAAA | 58 | 1510 |
| 1101958 | N/A | N/A | 15552 | 15571 | GTCTACTATATACATCTGAT | 48 | 1511 |
| 1101959 | N/A | N/A | 15555 | 15574 | CTAGTCTACTATATACATCT | 59 | 1512 |
| 1101960 | N/A | N/A | 15556 | 15575 | ACTAGTCTACTATATACATC | 77 | 1513 |
| 1101961 | N/A | N/A | 15561 | 15580 | TTAAAACTAGTCTACTATAT | 85 | 1514 |
| 1101962 | N/A | N/A | 15585 | 15604 | ATATTCTACCCATAAGTGCT | 34 | 1515 |
| 1101963 | N/A | N/A | 15588 | 15607 | TGTATATTCTACCCATAAGT | 66 | 1516 |
| 1101964 | N/A | N/A | 15601 | 15620 | TCAAAAATCCAGATGTATAT | 98 | 1517 |
| 1101965 | N/A | N/A | 15603 | 15622 | CCTCAAAAATCCAGATGTAT | 82 | 1518 |
| 1101966 | N/A | N/A | 15604 | 15623 | GCCTCAAAAATCCAGATGTA | 98 | 1519 |
| 1101967 | N/A | N/A | 15624 | 15643 | CACAATTCCTAAATAAAACT | 106 | 1520 |
| 1101968 | N/A | N/A | 15626 | 15645 | CACACAATTCCTAAATAAAA | 89 | 1521 |
| 1101969 | N/A | N/A | 15635 | 15654 | CCAGAAAACCACACAATTCC | 87 | 1522 |
| 1101970 | N/A | N/A | 15636 | 15655 | TCCAGAAAACCACACAATTC | 83 | 1523 |
| 1101971 | N/A | N/A | 15637 | 15656 | TTCCAGAAAACCACACAATT | 79 | 1524 |
| 1101972 | N/A | N/A | 15640 | 15659 | ATGTTCCAGAAAACCACACA | 66 | 1525 |
| 1101973 | N/A | N/A | 15643 | 15662 | GAGATGTTCCAGAAAACCAC | 43 | 1526 |
| 1101974 | N/A | N/A | 15666 | 15685 | AGTGCTTTTCATACCAGGTC | 6 | 1527 |
| 1101975 | N/A | N/A | 15667 | 15686 | GAGTGCTTTTCATACCAGGT | 6 | 1528 |
| 1101976 | N/A | N/A | 15704 | 15723 | CACTAAATCCATAAAAAAAA | 110 | 1529 |
| 1101977 | N/A | N/A | 15706 | 15725 | ATCACTAAATCCATAAAAAA | 101 | 1530 |
| 1101979 | N/A | N/A | 15712 | 15731 | AGATATATCACTAAATCCAT | 51 | 1531 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101981 | N/A | N/A | 15714 | 15733 | ATAGATATATCACTAAATCC | 63 | 1532 |
| 1101982 | N/A | N/A | 15715 | 15734 | TATAGATATATCACTAAATC | 103 | 1533 |
| 1101983 | N/A | N/A | 15719 | 15738 | TGTGTATAGATATATCACTA | 76 | 1534 |
| 1101984 | N/A | N/A | 15720 | 15739 | GTGTGTATAGATATATCACT | 54 | 1535 |
| 1101985 | N/A | N/A | 15739 | 15758 | TATAGGTTTTAAAAAGTGTG | 42 | 1536 |
| 1101986 | N/A | N/A | 16063 | 16082 | TATAAATTTCTCTAGAAGGC | 58 | 1537 |
| 1101987 | N/A | N/A | 16064 | 16083 | ATATAAATTTCTCTAGAAGG | 78 | 1538 |
| 1101988 | N/A | N/A | 16068 | 16087 | TCATATATAAATTTCTCTAG | 102 | 1539 |
| 1101989 | N/A | N/A | 16110 | 16129 | CCATTCCAAATTTAGGAAGT | 74 | 1540 |
| 1101990 | N/A | N/A | 16113 | 16132 | ACTCCATTCCAAATTTAGGA | 60 | 1541 |
| 1101991 | N/A | N/A | 16136 | 16155 | AGCAACTTTTCATAAGCTAA | 75 | 1542 |
| 1101992 | N/A | N/A | 16160 | 16179 | TGCTTATAACCTGTTAAGAA | 28 | 1543 |
| 1101993 | N/A | N/A | 16258 | 16277 | GAAATGCAAAACAGAATCTT | 70 | 1544 |
| 1101994 | N/A | N/A | 16297 | 16316 | TTACAACTTTAAAAATCAAA | 72 | 1545 |
| 1101995 | N/A | N/A | 16306 | 16325 | TTTAAGAAATTACAACTTTA | 89 | 1546 |
| 1101996 | N/A | N/A | 16330 | 16349 | AGTATTCAAAATGTATTTCT | 80 | 1547 |
| 1101997 | N/A | N/A | 16345 | 16364 | GAACATCAAAACAAAGTAT | 86 | 1548 |
| 1101998 | N/A | N/A | 16385 | 16404 | CACAAAGGTGAAATAGGAAA | 66 | 1549 |
| 1101999 | N/A | N/A | 16529 | 16548 | ATCACACAACCATATGAACG | 70 | 1550 |
| 1102000 | N/A | N/A | 16538 | 16557 | TTTTAAAGATCACACAACC | 86 | 1551 |
| 1102001 | N/A | N/A | 16540 | 16559 | GTTTTTAAAAGATCACACAA | 60 | 1552 |
| 1102002 | N/A | N/A | 16543 | 16562 | GATGTTTTTAAAAGATCACA | 61 | 1553 |
| 1102003 | N/A | N/A | 16546 | 16565 | ACTGATGTTTTTAAAAGATC | 45 | 1554 |
| 1102004 | N/A | N/A | 16547 | 16566 | CACTGATGTTTTTAAAAGAT | 53 | 1555 |
| 1102005 | N/A | N/A | 16571 | 16590 | AAGATTATATTTATAGTTAA | 121 | 1556 |
| 1102006 | N/A | N/A | 16572 | 16591 | TAAGATTATATTTATAGTTA | 94 | 1557 |
| 1102007 | N/A | N/A | 16581 | 16600 | GTGATAATTTAAGATTATAT | 51 | 1558 |
| 1102008 | N/A | N/A | 16584 | 16603 | TTTGTGATAATTTAAGATTA | 125 | 1559 |
| 1102009 | N/A | N/A | 16588 | 16607 | AAAATTTGTGATAATTTAAG | 136 | 1560 |
| 1102010 | N/A | N/A | 16601 | 16620 | GCAAATATTATATAAAATTT | 85 | 1561 |
| 1102011 | N/A | N/A | 16603 | 16622 | TGGCAAATATTATATAAAAT | 84 | 1562 |
| 1102012 | N/A | N/A | 16627 | 16646 | TGAATTCATATTTATGTTGT | 54 | 1563 |
| 1102013 | N/A | N/A | 16637 | 16656 | CTTGAAATATTGAATTCATA | 85 | 1564 |
| 1102015 | N/A | N/A | 16655 | 16674 | GAAAACAGACAATATTAACT | 89 | 1565 |
| 1102017 | N/A | N/A | 16680 | 16699 | TAAATGATCTTTCATTTCTA | 57 | 1566 |
| 1102018 | N/A | N/A | 16732 | 16751 | ACCTGTTTTCCTAATTTTCT | 68 | 1567 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102019 | N/A | N/A | 16748 | 16767 | AAGGGTAAGAAATGTTACCT | 113 | 1568 |
| 1102020 | N/A | N/A | 16768 | 16787 | TATAAGAAAAAAGACAAGG | 114 | 1569 |
| 1102021 | N/A | N/A | 16771 | 16790 | CAATATAAGAAAAAAGACA | 85 | 1570 |
| 1102022 | N/A | N/A | 16800 | 16819 | TGGCCCACATTTTAGTTTTA | 91 | 1571 |
| 1102023 | N/A | N/A | 17168 | 17187 | AATTTTAAAGTCAGCAATCC | 43 | 1572 |
| 1102024 | N/A | N/A | 17172 | 17191 | TCCTAATTTTAAAGTCAGCA | 8 | 1573 |
| 1102025 | N/A | N/A | 17173 | 17192 | TTCCTAATTTTAAAGTCAGC | 102 | 1574 |
| 1102026 | N/A | N/A | 17174 | 17193 | TTTCCTAATTTTAAAGTCAG | 88 | 1575 |
| 1102027 | N/A | N/A | 17175 | 17194 | GTTTCCTAATTTTAAAGTCA | 26 | 1576 |
| 1102028 | N/A | N/A | 17180 | 17199 | GGTCAGTTTCCTAATTTTAA | 4 | 1577 |
| 1102029 | N/A | N/A | 17237 | 17256 | AATGACAATTTCTATCTATC | 64 | 1578 |
| 1102030 | N/A | N/A | 17252 | 17271 | GATATTATCTTTTAAAATGA | 88 | 1579 |
| 1102031 | N/A | N/A | 17277 | 17296 | CACAAATAAATTTATAAGGA | 108 | 1580 |
| 1102032 | N/A | N/A | 17283 | 17302 | ACTTGTCACAAATAAATTTA | 113 | 1581 |
| 1102033 | N/A | N/A | 17284 | 17303 | TACTTGTCACAAATAAATTT | 77 | 1582 |
| 1102034 | N/A | N/A | 17300 | 17319 | ATAGTTAAATTGCATATACT | 57 | 1583 |
| 1102035 | N/A | N/A | 17304 | 17323 | TGATATAGTTAAATTGCATA | 51 | 1584 |
| 1102036 | N/A | N/A | 17312 | 17331 | TTTTCTTATGATATAGTTAA | 70 | 1585 |
| 1102037 | N/A | N/A | 17318 | 17337 | TAGAATTTTCTTATGATAT | 78 | 1586 |
| 1102038 | N/A | N/A | 17319 | 17338 | ATAGAATTTTCTTATGATA | 83 | 1587 |
| 1102039 | N/A | N/A | 17323 | 17342 | TAATATAGAATTTTCTTAT | 94 | 1588 |
| 1102040 | N/A | N/A | 17335 | 17354 | TTGTATTATCTTTAATATAG | 66 | 1589 |
| 1102041 | N/A | N/A | 17365 | 17384 | ACATAAAAACCCACTTAAAA | 89 | 1590 |
| 1102042 | N/A | N/A | 17369 | 17388 | CATCACATAAAAACCCACTT | 59 | 1591 |
| 1102043 | N/A | N/A | 17378 | 17397 | GAACATAGTCATCACATAAA | 25 | 1592 |
| 1102044 | N/A | N/A | 17380 | 17399 | CAGAACATAGTCATCACATA | 47 | 1593 |
| 1102045 | N/A | N/A | 17417 | 17436 | TGCTAAATACAAATCTATAA | 97 | 1594 |
| 1102046 | N/A | N/A | 17419 | 17438 | TATGCTAAATACAAATCTAT | 116 | 1595 |
| 1102047 | N/A | N/A | 17420 | 17439 | CTATGCTAAATACAAATCTA | 94 | 1596 |
| 1102048 | N/A | N/A | 17421 | 17440 | ACTATGCTAAATACAAATCT | 70 | 1597 |
| 1102049 | N/A | N/A | 17446 | 17465 | ACACTATTTCAGGCTTTGTG | 15 | 1598 |
| 1102051 | N/A | N/A | 17464 | 17483 | ATGCTTTATTCATGCTTGAC | 29 | 1599 |
| 1102053 | N/A | N/A | 17494 | 17513 | ATAATCTTACACTAAAGCAA | 85 | 1600 |
| 1102054 | N/A | N/A | 17497 | 17516 | TGAATAATCTTACACTAAAG | 86 | 1601 |
| 1102055 | N/A | N/A | 17498 | 17517 | ATGAATAATCTTACACTAAA | 81 | 1602 |
| 1102056 | N/A | N/A | 17505 | 17524 | AATCATAATGAATAATCTTA | 85 | 1603 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102057 | N/A | N/A | 17576 | 17595 | AGACATATTTCATGTTTTAT | 40 | 1604 |
| 1102058 | N/A | N/A | 17577 | 17596 | AAGACATATTTCATGTTTTA | 64 | 1605 |
| 1102059 | N/A | N/A | 17578 | 17597 | CAAGACATATTTCATGTTTT | 56 | 1606 |
| 1102060 | N/A | N/A | 17583 | 17602 | TTGCTCAAGACATATTTCAT | 30 | 1607 |
| 1102061 | N/A | N/A | 17584 | 17603 | CTTGCTCAAGACATATTTCA | 84 | 1608 |
| 1102062 | N/A | N/A | 17599 | 17618 | TGTTTCTTAAAATAGCTTGC | 33 | 1609 |
| 1102063 | N/A | N/A | 17632 | 17651 | TTCAAAATTCTAATAACAAG | 104 | 1610 |
| 1102064 | N/A | N/A | 17635 | 17654 | AGATTCAAAATTCTAATAAC | 121 | 1611 |
| 1102065 | N/A | N/A | 17644 | 17663 | CTCTTTCAAAGATTCAAAAT | 72 | 1612 |
| 1102066 | N/A | N/A | 17647 | 17666 | ACCCTCTTTCAAAGATTCAA | 64 | 1613 |
| 1102067 | N/A | N/A | 17654 | 17673 | TTCAATAACCCTCTTTCAAA | 89 | 1614 |
| 1102068 | N/A | N/A | 17779 | 17798 | TAAATGATACCATACAGCAG | 69 | 1615 |
| 1102069 | N/A | N/A | 17783 | 17802 | TTAATAAATGATACCATACA | 79 | 1616 |
| 1102070 | N/A | N/A | 17794 | 17813 | TTTCTAGACTTTTAATAAAT | 91 | 1617 |
| 1102071 | N/A | N/A | 17941 | 17960 | TACTACAACCAAGATAGTGA | 93 | 1618 |
| 1102072 | N/A | N/A | 17963 | 17982 | TACTGTACTCCCATGAAACC | 61 | 1619 |
| 1102073 | N/A | N/A | 17971 | 17990 | CATTTGTATACTGTACTCCC | 28 | 1620 |
| 1102074 | N/A | N/A | 18368 | 18387 | TTGGCTTGTATTTACATTTT | 6 | 1621 |
| 1102075 | N/A | N/A | 18406 | 18425 | AGATTTAATTCAATATATTT | 79 | 1622 |
| 1102076 | N/A | N/A | 18413 | 18432 | CTCTTACAGATTTAATTCAA | 49 | 1623 |
| 1102077 | N/A | N/A | 18427 | 18446 | TGTTTTTGAATTATCTCTTA | 19 | 1624 |
| 1102078 | N/A | N/A | 18448 | 18467 | AAAAGATAACAATAGGGTTT | 53 | 1625 |
| 1102079 | N/A | N/A | 18449 | 18468 | TAAAAGATAACAATAGGGTT | 57 | 1626 |
| 1102080 | N/A | N/A | 18452 | 18471 | ACTTAAAAGATAACAATAGG | 85 | 1627 |
| 1102081 | N/A | N/A | 18454 | 18473 | TGACTTAAAAGATAACAATA | 88 | 1628 |
| 1102082 | N/A | N/A | 18458 | 18477 | TGGGTGACTTAAAAGATAAC | 81 | 1629 |
| 1102083 | N/A | N/A | 18461 | 18480 | ATTTGGGTGACTTAAAAGAT | 83 | 1630 |
| 1102084 | N/A | N/A | 18478 | 18497 | GACTTTTCCCAAATTTGATT | 11 | 1631 |
| 1102085 | N/A | N/A | 18480 | 18499 | GTGACTTTTCCCAAATTTGA | 18 | 1632 |
| 1102087 | N/A | N/A | 18833 | 18852 | TTAAGAAAGAACCAACTTAG | 92 | 1633 |
| 1102089 | N/A | N/A | 18844 | 18863 | CAGGAAGAACTTTAAGAAAG | 52 | 1634 |
| 1102090 | N/A | N/A | 18875 | 18894 | GTTACATCTCCTTAACTTGC | 14 | 1635 |
| 1102091 | N/A | N/A | 18903 | 18922 | CCAGCTAGCCTCCACTGTAA | 76 | 1636 |
| 1102092 | N/A | N/A | 18905 | 18924 | ACCCAGCTAGCCTCCACTGT | 168 | 1637 |
| 1102093 | N/A | N/A | 19119 | 19138 | TTAATAATCTCAGCAGTAC | 43 | 1638 |
| 1102094 | N/A | N/A | 19123 | 19142 | GAGGTTAAATAATCTCAGCA | 82 | 1639 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102095 | N/A | N/A | 19124 | 19143 | AGAGGTTAAATAATCTCAGC | 67 | 1640 |
| 1102096 | N/A | N/A | 19125 | 19144 | CAGAGGTTAAATAATCTCAG | 95 | 1641 |
| 1102097 | N/A | N/A | 19126 | 19145 | CCAGAGGTTAAATAATCTCA | 98 | 1642 |
| 1102098 | N/A | N/A | 19127 | 19146 | CCCAGAGGTTAAATAATCTC | 69 | 1643 |
| 1102099 | N/A | N/A | 19135 | 19154 | AAATAAACCCAGAGGTTAA | 79 | 1644 |
| 1102100 | N/A | N/A | 19136 | 19155 | TAAATAAACCCAGAGGTTA | 81 | 1645 |
| 1102101 | N/A | N/A | 19137 | 19156 | ATAAATAAACCCAGAGGTT | 85 | 1646 |
| 1102102 | N/A | N/A | 19192 | 19211 | GCTTACTTTATACAAAAAA | 65 | 1647 |
| 1102103 | N/A | N/A | 19194 | 19213 | GTGCTTACTTTATACAAAA | 17 | 1648 |
| 1102104 | N/A | N/A | 19196 | 19215 | CAGTGCTTACTTTATACAAA | 4 | 1649 |
| 1102105 | N/A | N/A | 19207 | 19226 | CCTTAAAAATTCAGTGCTTA | 31 | 1650 |
| 1102106 | N/A | N/A | 19208 | 19227 | ACCTTAAAAATTCAGTGCTT | 29 | 1651 |
| 1102107 | N/A | N/A | 19216 | 19235 | TTAATACAACCTTAAAAATT | 87 | 1652 |
| 1102108 | N/A | N/A | 19222 | 19241 | TGCAAATTAATACAACCTTA | 17 | 1653 |
| 1102109 | N/A | N/A | 19232 | 19251 | GACATTTATTTGCAAATTAA | 30 | 1654 |
| 1102110 | N/A | N/A | 19238 | 19257 | AAGATAGACATTTATTTGCA | 12 | 1655 |
| 1102111 | N/A | N/A | 19239 | 19258 | TAAGATAGACATTTATTTGC | 27 | 1656 |
| 1102112 | N/A | N/A | 19241 | 19260 | AATAAGATAGACATTTATTT | 112 | 1657 |
| 1102113 | N/A | N/A | 19246 | 19265 | AAAATAATAAGATAGACATT | 100 | 1658 |
| 1102114 | N/A | N/A | 19249 | 19268 | CTCAAAATAATAAGATAGAC | 108 | 1659 |
| 1102115 | N/A | N/A | 19250 | 19269 | TCTCAAAATAATAAGATAGA | 71 | 1660 |
| 1102116 | N/A | N/A | 19251 | 19270 | CTCTCAAAATAATAAGATAG | 100 | 1661 |
| 1102117 | N/A | N/A | 19265 | 19284 | AAAATTTTTAAATCTCTCA | 97 | 1662 |
| 1102118 | N/A | N/A | 19296 | 19315 | TCAAAATGTGAAAATGCAAT | 81 | 1663 |
| 1102119 | N/A | N/A | 19340 | 19359 | AACCAAAATTTGACATCTTC | 23 | 1664 |
| 1102120 | N/A | N/A | 19343 | 19362 | ATAAACCAAAATTTGACATC | 75 | 1665 |
| 1102121 | N/A | N/A | 19346 | 19365 | AAAATAAACCAAAATTTGAC | 126 | 1666 |
| 1102123 | N/A | N/A | 19393 | 19412 | ATAGTGAAAAATATAGTTTT | 91 | 1667 |
| 1102125 | N/A | N/A | 19395 | 19414 | CTATAGTGAAAAATATAGTT | 92 | 1668 |
| 1102126 | N/A | N/A | 19397 | 19416 | GTCTATAGTGAAAAATATAG | 90 | 1669 |
| 1102127 | N/A | N/A | 19430 | 19449 | TTCATTATACAGGGACCTCG | 60 | 1670 |
| 1102128 | N/A | N/A | 19437 | 19456 | CTTCTTTTTCATTATACAGG | 11 | 1671 |
| 1102129 | N/A | N/A | 19453 | 19472 | TAATACTTTTTCCAGCCTTC | 17 | 1672 |
| 1102130 | N/A | N/A | 19455 | 19474 | GTTAATACTTTTTCCAGCCT | 9 | 1673 |
| 1102131 | N/A | N/A | 19457 | 19476 | ATGTTAATACTTTTTCCAGC | 10 | 1674 |
| 1102132 | N/A | N/A | 19458 | 19477 | AATGTTAATACTTTTTCCAG | 63 | 1675 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102133 | N/A | N/A | 19460 | 19479 | ACAATGTTAATACTTTTTCC | 108 | 1676 |
| 1102134 | N/A | N/A | 19468 | 19487 | GGATTTTGACAATGTTAATA | 20 | 1677 |
| 1102135 | N/A | N/A | 19498 | 19517 | CGATCAATATCATGACCAAC | 46 | 1678 |
| 1102136 | N/A | N/A | 19517 | 19536 | AAAAGTTTCTAAAGTTAAC | 187 | 1679 |
| 1102137 | N/A | N/A | 19527 | 19546 | CACAAGATACAAAAGTTTC | 107 | 1680 |
| 1102138 | N/A | N/A | 19530 | 19549 | ACCCACAAGATACAAAAGT | 87 | 1681 |
| 1102139 | N/A | N/A | 19531 | 19550 | AACCCACAAGATACAAAAG | 101 | 1682 |
| 1102140 | N/A | N/A | 19532 | 19551 | TAACCCACAAGATACAAAA | 88 | 1683 |
| 1102141 | N/A | N/A | 19537 | 19556 | TAATTTAACCCACAAGATAC | 65 | 1684 |
| 1102142 | N/A | N/A | 19538 | 19557 | CTAATTTAACCCACAAGATA | 75 | 1685 |
| 1102143 | N/A | N/A | 19542 | 19561 | AATCCTAATTTAACCCACAA | 58 | 1686 |
| 1102144 | N/A | N/A | 19544 | 19563 | GTAATCCTAATTTAACCCAC | 39 | 1687 |
| 1102145 | N/A | N/A | 19548 | 19567 | CATAGTAATCCTAATTTAAC | 94 | 1688 |
| 1102146 | N/A | N/A | 19564 | 19583 | TCATTTATCACTACCACATA | 64 | 1689 |
| 1102147 | N/A | N/A | 19567 | 19586 | ACATCATTTATCACTACCAC | 27 | 1690 |
| 1102148 | N/A | N/A | 19571 | 19590 | ATTAACATCATTTATCACTA | 80 | 1691 |
| 1102149 | N/A | N/A | 19574 | 19593 | CTAATTAACATCATTTATCA | 109 | 1692 |
| 1102150 | N/A | N/A | 19575 | 19594 | CCTAATTAACATCATTTATC | 88 | 1693 |
| 1102151 | N/A | N/A | 19576 | 19595 | CCCTAATTAACATCATTTAT | 91 | 1694 |
| 1102152 | N/A | N/A | 19577 | 19596 | GCCCTAATTAACATCATTTA | 88 | 1695 |
| 1102153 | N/A | N/A | 19579 | 19598 | CGGCCCTAATTAACATCATT | 118 | 1696 |
| 1102154 | N/A | N/A | 19580 | 19599 | TCGGCCCTAATTAACATCAT | 76 | 1697 |
| 1102155 | N/A | N/A | 19581 | 19600 | CTCGGCCCTAATTAACATCA | 88 | 1698 |
| 1102156 | N/A | N/A | 19585 | 19604 | TGCACTCGGCCCTAATTAAC | 55 | 1699 |
| 1102157 | N/A | N/A | 19685 | 19704 | GGTCTTACACTATGTTGTAC | 73 | 1700 |
| 1102159 | N/A | N/A | 19881 | 19900 | CACATATAACATATAAACAC | 99 | 1701 |
| 1102161 | N/A | N/A | 19883 | 19902 | ATCACATATAACATATAAAC | 108 | 1702 |
| 1102162 | N/A | N/A | 19887 | 19906 | CACTATCACATATAACATAT | 45 | 1703 |
| 1102163 | N/A | N/A | 19918 | 19937 | GTCTCTATAATTTAAAAATG | 95 | 1704 |
| 1102164 | N/A | N/A | 20063 | 20082 | CAGCTCAGTTTTTAAAAATC | 55 | 1705 |
| 1102165 | N/A | N/A | 20074 | 20093 | TTTATAATTACCAGCTCAGT | 36 | 1706 |
| 1102166 | N/A | N/A | 20077 | 20096 | GAATTTATAATTACCAGCTC | 23 | 1707 |
| 1102167 | N/A | N/A | 20084 | 20103 | AGGAAGAGAATTTATAATTA | 98 | 1708 |
| 1102168 | N/A | N/A | 20105 | 20124 | TGTGAGAAAGTCAGAAGTTC | 61 | 1709 |
| 1102169 | N/A | N/A | 20122 | 20141 | TGTCAAAGATTCCAATTGT | 118 | 1710 |
| 1102170 | N/A | N/A | 20124 | 20143 | TTTGTCAAAAGATTCCAATT | 77 | 1711 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102171 | N/A | N/A | 20128 | 20147 | AATTTTTGTCAAAAGATTCC | 68 | 1712 |
| 1102172 | N/A | N/A | 20147 | 20166 | AAGTTTTCCCATTACTGATA | 49 | 1713 |
| 1102173 | N/A | N/A | 20163 | 20182 | AAATGACAACTACACAAAGT | 96 | 1714 |
| 1102174 | N/A | N/A | 20204 | 20223 | CAACATAACTCCAATCATAT | 97 | 1715 |
| 1102175 | N/A | N/A | 20222 | 20241 | TTTTTCAAAATATCAGTCCA | 45 | 1716 |
| 1102176 | N/A | N/A | 20223 | 20242 | TTTTTTCAAAATATCAGTCC | 55 | 1717 |
| 1102177 | N/A | N/A | 20238 | 20257 | AGCTATAATTAAATCTTTTT | 67 | 1718 |
| 1102178 | N/A | N/A | 20253 | 20272 | AATGTCTTTATTAATAGCTA | 47 | 1719 |
| 1102179 | N/A | N/A | 20254 | 20273 | AAATGTCTTTATTAATAGCT | 70 | 1720 |
| 1102180 | N/A | N/A | 20264 | 20283 | TCAGTAGTTTAAATGTCTTT | 18 | 1721 |
| 1102181 | N/A | N/A | 20289 | 20308 | CTCCCAAAAGAATAAAAATG | 97 | 1722 |
| 1102182 | N/A | N/A | 20294 | 20313 | AAACCCTCCCAAAAGAATAA | 92 | 1723 |
| 1102183 | N/A | N/A | 20299 | 20318 | ACATTAAACCCTCCCAAAAG | 83 | 1724 |
| 1102184 | N/A | N/A | 20300 | 20319 | AACATTAAACCCTCCCAAAA | 90 | 1725 |
| 1102185 | N/A | N/A | 20304 | 20323 | TATAAACATTAAACCCTCCC | 102 | 1726 |
| 1102186 | N/A | N/A | 20306 | 20325 | ACTATAAACATTAAACCCTC | 117 | 1727 |
| 1102187 | N/A | N/A | 20307 | 20326 | AACTATAAACATTAAACCCT | 86 | 1728 |
| 1102188 | N/A | N/A | 20311 | 20330 | TTTAAACTATAAACATTAAA | 87 | 1729 |
| 1102189 | N/A | N/A | 20314 | 20333 | TGCTTTAAACTATAAACATT | 72 | 1730 |
| 1102190 | N/A | N/A | 20315 | 20334 | TTGCTTTAAACTATAAACAT | 84 | 1731 |
| 1102191 | N/A | N/A | 20316 | 20335 | TTTGCTTTAAACTATAAACA | 91 | 1732 |
| 1102192 | N/A | N/A | 20318 | 20337 | AGTTTGCTTTAAACTATAAA | 75 | 1733 |
| 1102193 | N/A | N/A | 20976 | 20995 | TATCACTATTAAATACTTTT | 70 | 1734 |
| 1102195 | N/A | N/A | 20988 | 21007 | ATACTGCAGATTTATCACTA | 26 | 1735 |
| 1102197 | N/A | N/A | 21022 | 21041 | GACTGAATAATATGATCTTA | 27 | 1736 |
| 1102198 | N/A | N/A | 21051 | 21070 | GAAATATTTCAAGTTGAGCT | 15 | 1737 |
| 1102199 | N/A | N/A | 21053 | 21072 | TGGAAATATTTCAAGTTGAG | 27 | 1738 |
| 1102200 | N/A | N/A | 21054 | 21073 | CTGGAAATATTTCAAGTTGA | 15 | 1739 |
| 1102201 | N/A | N/A | 21055 | 21074 | TCTGGAAATATTTCAAGTTG | 43 | 1740 |
| 1102202 | N/A | N/A | 21069 | 21088 | AAGATTGTTTAAACTCTGGA | 16 | 1741 |
| 1102203 | N/A | N/A | 21093 | 21112 | AGATACAACCCATCAAAGCT | 89 | 1742 |
| 1102204 | N/A | N/A | 21094 | 21113 | TAGATACAACCCATCAAAGC | 145 | 1743 |
| 1102205 | N/A | N/A | 21101 | 21120 | TTAAGAATAGATACAACCCA | 99 | 1744 |
| 1102206 | N/A | N/A | 21106 | 21125 | ACATGTTAAGAATAGATACA | 86 | 1745 |
| 1102207 | N/A | N/A | 21116 | 21135 | AGGAAGTTTCACATGTTAAG | 71 | 1746 |
| 1102208 | N/A | N/A | 21152 | 21171 | TGTCAATATTTAAGTTAGTG | 93 | 1747 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102209 | N/A | N/A | 21153 | 21172 | TTGTCAATATTTAAGTTAGT | 77 | 1748 |
| 1102210 | N/A | N/A | 21154 | 21173 | ATTGTCAATATTTAAGTTAG | 84 | 1749 |
| 1102211 | N/A | N/A | 21178 | 21197 | TTCAAGTTAAACCACTGGAA | 77 | 1750 |
| 1102212 | N/A | N/A | 21180 | 21199 | AATTCAAGTTAAACCACTGG | 67 | 1751 |
| 1102213 | N/A | N/A | 21260 | 21279 | TTACTTACCTTCCTGTTGTA | 73 | 1752 |
| 1102214 | N/A | N/A | 21284 | 21303 | GTAACATTACAAAATGTTCA | 78 | 1753 |
| 1102215 | N/A | N/A | 21304 | 21323 | TTATTTAACTACTTCGAAAG | 84 | 1754 |
| 1102216 | N/A | N/A | 21311 | 21330 | TGCCTGGTTATTTAACTACT | 27 | 1755 |
| 1102217 | N/A | N/A | 21398 | 21417 | CAAATCACAGCCTATCACCA | 93 | 1756 |
| 1102218 | N/A | N/A | 21402 | 21421 | CACCCAAATCACAGCCTATC | 82 | 1757 |
| 1102219 | N/A | N/A | 21403 | 21422 | TCACCCAAATCACAGCCTAT | 62 | 1758 |
| 1102220 | N/A | N/A | 21404 | 21423 | GTCACCCAAATCACAGCCTA | 46 | 1759 |
| 1102221 | N/A | N/A | 21495 | 21514 | AGAAAAAGCCATTACTTAGA | 51 | 1760 |
| 1102222 | N/A | N/A | 21497 | 21516 | AAAGAAAAAGCCATTACTTA | 89 | 1761 |
| 1102223 | N/A | N/A | 21604 | 21623 | CATGTATTTCAAAGAAACTG | 62 | 1762 |
| 1102224 | N/A | N/A | 21955 | 21974 | CAAGGGATAGTTTAATCTAG | 70 | 1763 |
| 1102225 | N/A | N/A | 22004 | 22023 | GATCCTAAAATCACTGATGA | 85 | 1764 |
| 1102226 | N/A | N/A | 22005 | 22024 | AGATCCTAAAATCACTGATG | 64 | 1765 |
| 1102227 | N/A | N/A | 22007 | 22026 | TCAGATCCTAAAATCACTGA | 83 | 1766 |
| 1102228 | N/A | N/A | 22008 | 22027 | GTCAGATCCTAAAATCACTG | 47 | 1767 |
| 1102229 | N/A | N/A | 22009 | 22028 | AGTCAGATCCTAAAATCACT | 64 | 1768 |
| 1102231 | N/A | N/A | 22067 | 22086 | GACGATACAGAAATAATTAA | 73 | 1769 |
| 1102233 | N/A | N/A | 22204 | 22223 | AACATGGTTTAAAGATAGGA | 85 | 1770 |
| 1102234 | N/A | N/A | 22213 | 22232 | AACAGACAAAACATGGTTTA | 75 | 1771 |
| 1102235 | N/A | N/A | 22240 | 22259 | GGGTTTAAAGAATGGCTGGA | 64 | 1772 |
| 1102236 | N/A | N/A | 22244 | 22263 | AGTAGGGTTTAAAGAATGGC | 65 | 1773 |
| 1102237 | N/A | N/A | 22330 | 22349 | CAATGGAGTGATTATGATGA | 63 | 1774 |
| 1102238 | N/A | N/A | 22381 | 22400 | TTTGTCATTCAAGTATGATG | 41 | 1775 |
| 1102239 | N/A | N/A | 22403 | 22422 | TGGTTTAACCAGGGTTGAGA | 18 | 1776 |
| 1102240 | N/A | N/A | 22462 | 22481 | TATGTTATTTTTTAGCCACG | 61 | 1777 |
| 1102241 | N/A | N/A | 22464 | 22483 | TTTATGTTATTTTTTAGCCA | 89 | 1778 |
| 1102242 | N/A | N/A | 22480 | 22499 | AAACCAATCATCATGTTTTA | 55 | 1779 |
| 1102243 | N/A | N/A | 22481 | 22500 | AAAACCAATCATCATGTTTT | 56 | 1780 |
| 1102244 | N/A | N/A | 22482 | 22501 | TAAAACCAATCATCATGTTT | 47 | 1781 |
| 1102245 | N/A | N/A | 22486 | 22505 | AAAGTAAAACCAATCATCAT | 84 | 1782 |
| 1102246 | N/A | N/A | 22505 | 22524 | GGATAGATCATTTAAGAAAA | 38 | 1783 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102247 | N/A | N/A | 22589 | 22608 | ATGAGCTGTGATTATGCTGC | 82 | 1784 |
| 1102248 | N/A | N/A | 22691 | 22710 | AAAGTAAAACCTTAGCTAGG | 74 | 1785 |
| 1102249 | N/A | N/A | 22692 | 22711 | TAAAGTAAAACCTTAGCTAG | 105 | 1786 |
| 1102250 | N/A | N/A | 22695 | 22714 | ATTTAAAGTAAAACCTTAGC | 110 | 1787 |
| 1102251 | N/A | N/A | 22701 | 22720 | TAATAAATTTAAAGTAAAAC | 111 | 1788 |
| 1102252 | N/A | N/A | 22706 | 22725 | GATTATAATAAATTTAAAGT | 76 | 1789 |
| 1102253 | N/A | N/A | 22710 | 22729 | TTGTGATTATAATAAATTTA | 77 | 1790 |
| 1102254 | N/A | N/A | 22711 | 22730 | TTTGTGATTATAATAAATTT | 109 | 1791 |
| 1102255 | N/A | N/A | 22713 | 22732 | ATTTTGTGATTATAATAAAT | 97 | 1792 |
| 1102256 | N/A | N/A | 22715 | 22734 | GAATTTTGTGATTATAATAA | 112 | 1793 |
| 1102257 | N/A | N/A | 22748 | 22767 | GTAGAAATATCAGACAGCAC | 82 | 1794 |
| 1102258 | N/A | N/A | 22752 | 22771 | CATAGTAGAAATATCAGACA | 108 | 1795 |
| 1102259 | N/A | N/A | 22754 | 22773 | AACATAGTAGAAATATCAGA | 86 | 1796 |
| 1102260 | N/A | N/A | 22762 | 22781 | ACTAAGAAAACATAGTAGAA | 81 | 1797 |
| 1102261 | N/A | N/A | 22794 | 22813 | TTTTTTATAAACACCTTGGA | 73 | 1798 |
| 1102262 | N/A | N/A | 22860 | 22879 | GTGAAATTAGTCACCTTGGA | 18 | 1799 |
| 1102263 | N/A | N/A | 22865 | 22884 | AAGCTGTGAAATTAGTCACC | 41 | 1800 |
| 1102264 | N/A | N/A | 22867 | 22886 | ATAAGCTGTGAAATTAGTCA | 58 | 1801 |
| 1102265 | N/A | N/A | 22883 | 22902 | TTAAAGGTTTAAAGACATAA | 109 | 1802 |
| 1102267 | N/A | N/A | 22965 | 22984 | AACATAATTTTAATTGCTTC | 62 | 1803 |
| 1102269 | N/A | N/A | 22967 | 22986 | AGAACATAATTTTAATTGCT | 75 | 1804 |
| 1102270 | N/A | N/A | 22997 | 23016 | ATAAGCAAATTGATAAATTT | 91 | 1805 |
| 1102271 | N/A | N/A | 23008 | 23027 | CAGGTGAAGATATAAGCAAA | 66 | 1806 |
| 1102272 | N/A | N/A | 23010 | 23029 | CACAGGTGAAGATATAAGCA | 78 | 1807 |
| 1102273 | N/A | N/A | 23012 | 23031 | AGCACAGGTGAAGATATAAG | 68 | 1808 |
| 1102274 | N/A | N/A | 23037 | 23056 | CATTCATCTATTTAAATAGG | 64 | 1809 |
| 1102275 | N/A | N/A | 23150 | 23169 | GAACTGATTATATAAGAGAG | 74 | 1810 |
| 1102276 | N/A | N/A | 23175 | 23194 | GGAATATTACAAAAAAGGG | 102 | 1811 |
| 1102277 | N/A | N/A | 23289 | 23308 | AGAGACAATCCTAAGGAAAA | 93 | 1812 |
| 1102278 | N/A | N/A | 23290 | 23309 | TAGAGACAATCCTAAGGAAA | 52 | 1813 |
| 1102279 | N/A | N/A | 23293 | 23312 | CACTAGAGACAATCCTAAGG | 69 | 1814 |
| 1102280 | N/A | N/A | 23603 | 23622 | ATGGAGAAACCCCTTCCATC | 74 | 1815 |
| 1102281 | N/A | N/A | 23874 | 23893 | ATACCATTACTAAAAGATGG | 79 | 1816 |
| 1102282 | N/A | N/A | 23879 | 23898 | TCCAAATACCATTACTAAAA | 49 | 1817 |
| 1102283 | N/A | N/A | 23880 | 23899 | CTCCAAATACCATTACTAAA | 41 | 1818 |
| 1102284 | N/A | N/A | 23883 | 23902 | GATCTCCAAATACCATTACT | 42 | 1819 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102285 | N/A | N/A | 23900 | 23919 | GCCAGCACTCAAATTGTGAT | 53 | 1820 |
| 1102286 | N/A | N/A | 23927 | 23946 | CATAACAAACCCAGCAGCAA | 91 | 1821 |
| 1102287 | N/A | N/A | 23933 | 23952 | TAACTACATAACAAACCCAG | 85 | 1822 |
| 1102288 | N/A | N/A | 23936 | 23955 | CAATAACTACATAACAAACC | 81 | 1823 |
| 1102289 | N/A | N/A | 23937 | 23956 | ACAATAACTACATAACAAAC | 96 | 1824 |
| 1102290 | N/A | N/A | 23939 | 23958 | TCACAATAACTACATAACAA | 74 | 1825 |
| 1102291 | N/A | N/A | 23940 | 23959 | TTCACAATAACTACATAACA | 78 | 1826 |
| 1102292 | N/A | N/A | 23941 | 23960 | ATTCACAATAACTACATAAC | 85 | 1827 |
| 1102293 | N/A | N/A | 23945 | 23964 | GTGAATTCACAATAACTACA | 61 | 1828 |
| 1102294 | N/A | N/A | 23946 | 23965 | TGTGAATTCACAATAACTAC | 88 | 1829 |
| 1102295 | N/A | N/A | 23947 | 23966 | ATGTGAATTCACAATAACTA | 89 | 1830 |
| 1102296 | N/A | N/A | 23959 | 23978 | CTATATTCCTAAATGTGAAT | 85 | 1831 |
| 1102297 | N/A | N/A | 23964 | 23983 | AAACCCTATATTCCTAAATG | 107 | 1832 |
| 1102298 | N/A | N/A | 23970 | 23989 | AATTAAAAACCCTATATTCC | 91 | 1833 |
| 1102299 | N/A | N/A | 23971 | 23990 | GAATTAAAAACCCTATATTC | 93 | 1834 |
| 1102300 | N/A | N/A | 23984 | 24003 | ATCTAAAATCAAAGAATTAA | 93 | 1835 |
| 1102301 | N/A | N/A | 23985 | 24004 | TATCTAAAATCAAAGAATTA | 127 | 1836 |
| 1102303 | N/A | N/A | 23987 | 24006 | AGTATCTAAAATCAAAGAAT | 93 | 1837 |
| 1102305 | N/A | N/A | 23990 | 24009 | ACAAGTATCTAAAATCAAAG | 83 | 1838 |
| 1102306 | N/A | N/A | 23991 | 24010 | TACAAGTATCTAAAATCAAA | 124 | 1839 |
| 1102307 | N/A | N/A | 23998 | 24017 | AAAAAGATACAAGTATCTAA | 113 | 1840 |
| 1102308 | N/A | N/A | 24001 | 24020 | AGAAAAAGATACAAGTATC | 82 | 1841 |
| 1102309 | N/A | N/A | 24017 | 24036 | AGGTTTTAAATATAAAAGAA | 94 | 1842 |
| 1102310 | N/A | N/A | 24020 | 24039 | CCAAGGTTTTAAATATAAAA | 75 | 1843 |
| 1102311 | N/A | N/A | 24070 | 24089 | GCTGAAGGCCAAAGGTAGAC | 72 | 1844 |
| 1102312 | N/A | N/A | 24092 | 24111 | TAGGAAAACCACAGCATGGT | 85 | 1845 |
| 1102313 | N/A | N/A | 24093 | 24112 | TTAGGAAAACCACAGCATGG | 80 | 1846 |
| 1102314 | N/A | N/A | 24094 | 24113 | GTTAGGAAAACCACAGCATG | 94 | 1847 |
| 1102315 | N/A | N/A | 24145 | 24164 | ACAGATGATATTTAAGATCC | 66 | 1848 |
| 1102316 | N/A | N/A | 24158 | 24177 | ATAGATCTTATTTACAGATG | 103 | 1849 |
| 1102317 | N/A | N/A | 24194 | 24213 | CAAGACTAAAGATAAAAGTT | 85 | 1850 |
| 1102318 | N/A | N/A | 24197 | 24216 | TGTCAAGACTAAAGATAAAA | 82 | 1851 |
| 1102319 | N/A | N/A | 24199 | 24218 | GATGTCAAGACTAAAGATAA | 76 | 1852 |
| 1102320 | N/A | N/A | 24229 | 24248 | GGAGTTAGTCAAAGCTAGGT | 47 | 1853 |
| 1102321 | N/A | N/A | 24231 | 24250 | TAGGAGTTAGTCAAAGCTAG | 62 | 1854 |
| 1102322 | N/A | N/A | 24246 | 24265 | TGGAGATGCCAAAGCTAGGA | 28 | 1855 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102323 | N/A | N/A | 24292 | 24311 | TCTTTCATAGACATGTTCAG | 64 | 1856 |
| 1102324 | N/A | N/A | 24297 | 24316 | ATAAGTCTTTCATAGACATG | 98 | 1857 |
| 1102325 | N/A | N/A | 24337 | 24356 | AATGGAAAACCTGATGGATA | 84 | 1858 |
| 1102326 | N/A | N/A | 24355 | 24374 | AAGAGTCACCCTTATGGAAA | 68 | 1859 |
| 1102327 | N/A | N/A | 24382 | 24401 | CGGTATAATATATAGGAACC | 48 | 1860 |
| 1102328 | N/A | N/A | 24384 | 24403 | GTCGGTATAATATATAGGAA | 23 | 1861 |
| 1102329 | N/A | N/A | 24819 | 24838 | GGTTTTATTCAAGACTTCAC | 9 | 1862 |
| 1102330 | N/A | N/A | 24823 | 24842 | CTTGGGTTTTATTCAAGACT | 54 | 1863 |
| 1102331 | N/A | N/A | 24892 | 24911 | ACCATGGTATTCTATGAAGA | 70 | 1864 |
| 1102332 | N/A | N/A | 24909 | 24928 | AATAAATATGCCAGCTCACC | 39 | 1865 |
| 1102333 | N/A | N/A | 24914 | 24933 | TGTATAATAAATATGCCAGC | 23 | 1866 |
| 1102334 | N/A | N/A | 24915 | 24934 | TTGTATAATAAATATGCCAG | 31 | 1867 |
| 1102335 | N/A | N/A | 24936 | 24955 | GCCAGTAAAATTGTTTCTGT | 41 | 1868 |
| 1102336 | N/A | N/A | 24994 | 25013 | TGAACATTTTTATGAGGAC | 8 | 1869 |
| 1102337 | N/A | N/A | 24995 | 25014 | TTGAACATTTTTATGAGGA | 26 | 1870 |
| 1102339 | N/A | N/A | 25019 | 25038 | AATGGAAAACCTCAAAATAG | 75 | 1871 |
| 1102341 | N/A | N/A | 25438 | 25457 | ATCTAACTGATTTAAGTTTC | 112 | 1872 |
| 1102342 | N/A | N/A | 25449 | 25468 | TACCTAAAACAATCTAACTG | 103 | 1873 |
| 1102343 | N/A | N/A | 25453 | 25472 | GCTATACCTAAAACAATCTA | 68 | 1874 |
| 1102344 | N/A | N/A | 25454 | 25473 | GGCTATACCTAAAACAATCT | 55 | 1875 |
| 1102345 | N/A | N/A | 25455 | 25474 | GGGCTATACCTAAAACAATC | 55 | 1876 |
| 1102346 | N/A | N/A | 25457 | 25476 | ATGGGCTATACCTAAAACAA | 101 | 1877 |
| 1102347 | N/A | N/A | 25473 | 25492 | CACACAAAACCAAGGATGG | 59 | 1878 |
| 1102348 | N/A | N/A | 25499 | 25518 | CCAGGGTTTCCCCAAGCTAG | 54 | 1879 |
| 1102349 | N/A | N/A | 25507 | 25526 | CCAGAAATCCAGGGTTTCCC | 73 | 1880 |
| 1102350 | N/A | N/A | 25509 | 25528 | TTCCAGAAATCCAGGGTTTC | 56 | 1881 |
| 1102351 | N/A | N/A | 25513 | 25532 | ATGATTCCAGAAATCCAGGG | 18 | 1882 |
| 1102352 | N/A | N/A | 25515 | 25534 | ATATGATTCCAGAAATCCAG | 41 | 1883 |
| 1102353 | N/A | N/A | 25521 | 25540 | GTCTAAATATGATTCCAGAA | 6 | 1884 |
| 1102354 | N/A | N/A | 25545 | 25564 | ATTACATTAGTCTAGTGTGA | 51 | 1885 |
| 1102355 | N/A | N/A | 25550 | 25569 | AAAGAATTACATTAGTCTAG | 64 | 1886 |
| 1102356 | N/A | N/A | 25551 | 25570 | AAAAGAATTACATTAGTCTA | 87 | 1887 |
| 1102357 | N/A | N/A | 25554 | 25573 | CCCAAAAGAATTACATTAGT | 60 | 1888 |
| 1102358 | N/A | N/A | 25555 | 25574 | TCCCAAAAGAATTACATTAG | 67 | 1889 |
| 1102359 | N/A | N/A | 25556 | 25575 | ATCCCAAAAGAATTACATTA | 95 | 1890 |
| 1102360 | N/A | N/A | 25561 | 25580 | TTTGCATCCCAAAAGAATTA | 75 | 1891 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102361 | N/A | N/A | 25590 | 25609 | AAAAGCTATTTAAGGTGTCA | 26 | 1892 |
| 1102362 | N/A | N/A | 25591 | 25610 | TAAAAGCTATTTAAGGTGTC | 56 | 1893 |
| 1102363 | N/A | N/A | 25592 | 25611 | CTAAAAGCTATTTAAGGTGT | 67 | 1894 |
| 1102364 | N/A | N/A | 25600 | 25619 | CCAAATACCTAAAAGCTATT | 84 | 1895 |
| 1102365 | N/A | N/A | 25601 | 25620 | GCCAAATACCTAAAAGCTAT | 108 | 1896 |
| 1102366 | N/A | N/A | 25602 | 25621 | AGCCAAATACCTAAAAGCTA | 86 | 1897 |
| 1102367 | N/A | N/A | 25603 | 25622 | AAGCCAAATACCTAAAAGCT | 71 | 1898 |
| 1102368 | N/A | N/A | 25604 | 25623 | GAAGCCAAATACCTAAAAGC | 54 | 1899 |
| 1102369 | N/A | N/A | 25605 | 25624 | GGAAGCCAAATACCTAAAAG | 44 | 1900 |
| 1102370 | N/A | N/A | 25632 | 25651 | ACCCCTTGTAACTAAAAATA | 93 | 1901 |
| 1102371 | N/A | N/A | 25689 | 25708 | TGGCTAAAACTAATCATCTG | 71 | 1902 |
| 1102372 | N/A | N/A | 25690 | 25709 | ATGGCTAAAACTAATCATCT | 70 | 1903 |
| 1102373 | N/A | N/A | 25691 | 25710 | CATGGCTAAAACTAATCATC | 98 | 1904 |
| 1102375 | N/A | N/A | 25805 | 25824 | CATTACCCTTCATATATACA | 73 | 1905 |
| 1102377 | N/A | N/A | 25814 | 25833 | TCCTTAATACATTACCCTTC | 62 | 1906 |
| 1102378 | N/A | N/A | 25822 | 25841 | GTCGATACTCCTTAATACAT | 23 | 1907 |
| 1102379 | N/A | N/A | 26243 | 26262 | CTACAAATTATTGTTTCTGG | 17 | 1908 |
| 1102380 | N/A | N/A | 26245 | 26264 | GGCTACAAATTATTGTTTCT | 25 | 1909 |
| 1102381 | N/A | N/A | 26246 | 26265 | AGGCTACAAATTATTGTTTC | 58 | 1910 |
| 1102382 | N/A | N/A | 26247 | 26266 | AAGGCTACAAATTATTGTTT | 50 | 1911 |
| 1102383 | N/A | N/A | 26249 | 26268 | TGAAGGCTACAAATTATTGT | 40 | 1912 |
| 1102384 | N/A | N/A | 26311 | 26330 | ACTGTTAAACATATGATACT | 73 | 1913 |
| 1102385 | N/A | N/A | 26322 | 26341 | TCTTGGTTTCTACTGTTAAA | 78 | 1914 |
| 1102386 | N/A | N/A | 26455 | 26474 | AAAGGGCCCTACTAATATAG | 107 | 1915 |
| 1102387 | N/A | N/A | 26475 | 26494 | TGAGAAATAAATATGTCTGT | 79 | 1916 |
| 1102388 | N/A | N/A | 26525 | 26544 | CCTCACTTTCTCCATTGTAA | 47 | 1917 |
| 1102389 | N/A | N/A | 26577 | 26596 | TCTTATACTTACTAGTAAAG | 77 | 1918 |
| 1102390 | N/A | N/A | 26580 | 26599 | GATTCTTATACTTACTAGTA | 70 | 1919 |
| 1102391 | N/A | N/A | 26581 | 26600 | TGATTCTTATACTTACTAGT | 92 | 1920 |
| 1102392 | N/A | N/A | 26584 | 26603 | TAATGATTCTTATACTTACT | 59 | 1921 |
| 1102393 | N/A | N/A | 26585 | 26604 | ATAATGATTCTTATACTTAC | 87 | 1922 |
| 1102394 | N/A | N/A | 26593 | 26612 | TAGTCCAATAATGATTCTT | 50 | 1923 |
| 1102395 | N/A | N/A | 26629 | 26648 | TGGAAAAAATACAAGCTGA | 88 | 1924 |
| 1102396 | N/A | N/A | 26630 | 26649 | CTGGAAAAAATACAAGCTG | 68 | 1925 |
| 1102397 | N/A | N/A | 26631 | 26650 | ACTGGAAAAAATACAAGCT | 84 | 1926 |
| 1102398 | N/A | N/A | 26632 | 26651 | CACTGGAAAAAATACAAGC | 99 | 1927 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102399 | N/A | N/A | 26680 | 26699 | GATTCAAAATTGATGTAAAA | 95 | 1928 |
| 1102400 | N/A | N/A | 26681 | 26700 | AGATTCAAAATTGATGTAAA | 91 | 1929 |
| 1102401 | N/A | N/A | 26684 | 26703 | AAGAGATTCAAAATTGATGT | 124 | 1930 |
| 1102402 | N/A | N/A | 26685 | 26704 | AAAGAGATTCAAAATTGATG | 86 | 1931 |
| 1102403 | N/A | N/A | 26707 | 26726 | AAAATCAACCTAACCAGTTA | 87 | 1932 |
| 1102404 | N/A | N/A | 26708 | 26727 | AAAAATCAACCTAACCAGTT | 109 | 1933 |
| 1102405 | N/A | N/A | 26714 | 26733 | AAAGGCAAAAATCAACCTAA | 102 | 1934 |
| 1102406 | N/A | N/A | 26733 | 26752 | ATAGAATAACCTAAAAAAAA | 78 | 1935 |
| 1102407 | N/A | N/A | 26734 | 26753 | TATAGAATAACCTAAAAAAA | 131 | 1936 |
| 1102408 | N/A | N/A | 26737 | 26756 | AAATATAGAATAACCTAAAA | 102 | 1937 |
| 1102409 | N/A | N/A | 26739 | 26758 | ACAAATATAGAATAACCTAA | 95 | 1938 |
| 1102411 | N/A | N/A | 26870 | 26889 | GGCCTCATTTTTACCTTTGC | 85 | 1939 |
| 1102413 | N/A | N/A | 26898 | 26917 | GAAATACTACCATATATTCC | 89 | 1940 |
| 1102414 | N/A | N/A | 26923 | 26942 | AGCATGAAAATTTAATTCTC | 91 | 1941 |
| 1102415 | N/A | N/A | 26986 | 27005 | TTCACTAAAATATAAGGTCC | 73 | 1942 |
| 1102416 | N/A | N/A | 26995 | 27014 | CTAATAAACTTCACTAAAAT | 111 | 1943 |
| 1102417 | N/A | N/A | 26996 | 27015 | ACTAATAAACTTCACTAAAA | 70 | 1944 |
| 1102418 | N/A | N/A | 27008 | 27027 | ATTCAAGTTTAAACTAATAA | 85 | 1945 |
| 1102419 | N/A | N/A | 27027 | 27046 | TAAGTATTTCAAAGAGTTGA | 37 | 1946 |
| 1102420 | N/A | N/A | 27029 | 27048 | TTTAAGTATTTCAAAGAGTT | 110 | 1947 |
| 1102421 | N/A | N/A | 27036 | 27055 | TAATATATTTAAGTATTTCA | 82 | 1948 |
| 1102422 | N/A | N/A | 27043 | 27062 | ACTAAGTTAATATATTTAAG | 119 | 1949 |
| 1102423 | N/A | N/A | 27064 | 27083 | AGGAATATACCATACCAGCT | 34 | 1950 |
| 1102424 | N/A | N/A | 27066 | 27085 | CTAGGAATATACCATACCAG | 19 | 1951 |
| 1102425 | N/A | N/A | 27391 | 27410 | CTAGTAATATAATGATTGTG | 37 | 1952 |
| 1102426 | N/A | N/A | 27394 | 27413 | GCTCTAGTAATATAATGATT | 35 | 1953 |
| 1102427 | N/A | N/A | 27407 | 27426 | TTCTGGCAAATAAGCTCTAG | 44 | 1954 |
| 1102428 | N/A | N/A | 27470 | 27489 | TTAGACATAACATAAAGGCA | 68 | 1955 |
| 1102429 | N/A | N/A | 27481 | 27500 | AATCTTCTATTTTAGACATA | 93 | 1956 |
| 1102430 | N/A | N/A | 27486 | 27505 | CAACCAATCTTCTATTTTAG | 84 | 1957 |
| 1102431 | N/A | N/A | 27487 | 27506 | GCAACCAATCTTCTATTTTA | 83 | 1958 |
| 1102432 | N/A | N/A | 27492 | 27511 | TAACTGCAACCAATCTTCTA | 114 | 1959 |
| 1102433 | N/A | N/A | 27518 | 27537 | ACTCTAAAGAACAAAGCAC | 85 | 1960 |
| 1102434 | N/A | N/A | 27523 | 27542 | TATGGACTCTAAAGAACAAA | 75 | 1961 |
| 1102435 | N/A | N/A | 27690 | 27709 | GTCTTTACCTTGCATACTTA | 65 | 1962 |
| 1102436 | N/A | N/A | 27697 | 27716 | TCAGAATGTCTTTACCTTGC | 104 | 1963 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102437 | N/A | N/A | 27712 | 27731 | TGAATACAACACACATCAGA | 81 | 1964 |
| 1102438 | N/A | N/A | 27718 | 27737 | CAGCAATGAATACAACACAC | 84 | 1965 |
| 1102439 | N/A | N/A | 27720 | 27739 | TTCAGCAATGAATACAACAC | 75 | 1966 |
| 1102440 | N/A | N/A | 27729 | 27748 | AATCAATTCTTCAGCAATGA | 100 | 1967 |
| 1102441 | N/A | N/A | 27730 | 27749 | GAATCAATTCTTCAGCAATG | 70 | 1968 |
| 1102442 | N/A | N/A | 27748 | 27767 | GAAATCTAAGAATAATTGGA | 108 | 1969 |
| 1102443 | N/A | N/A | 27763 | 27782 | TACATTAACTTCCATGAAAT | 91 | 1970 |
| 1102444 | N/A | N/A | 27770 | 27789 | CTAAGAGTACATTAACTTCC | 68 | 1971 |
| 1102445 | N/A | N/A | 27786 | 27805 | AATTGTCAAAACACCTCTAA | 77 | 1972 |
| 1102447 | N/A | N/A | 27824 | 27843 | AAAGGGAAAGCCCACTATAT | 118 | 1973 |
| 1102449 | N/A | N/A | 27848 | 27867 | AGTGATTTCCATTATAAGAA | 71 | 1974 |
| 1102450 | N/A | N/A | 27849 | 27868 | AAGTGATTTCCATTATAAGA | 69 | 1975 |
| 1102451 | N/A | N/A | 27872 | 27891 | CCTAATAAAATATAGGTTGT | 82 | 1976 |
| 1102452 | N/A | N/A | 27873 | 27892 | TCCTAATAAAATATAGGTTG | 108 | 1977 |
| 1102453 | N/A | N/A | 27874 | 27893 | CTCCTAATAAAATATAGGTT | 86 | 1978 |
| 1102454 | N/A | N/A | 27875 | 27894 | ACTCCTAATAAAATATAGGT | 166 | 1979 |
| 1102455 | N/A | N/A | 27882 | 27901 | TATAACTACTCCTAATAAAA | 82 | 1980 |
| 1102456 | N/A | N/A | 27885 | 27904 | AAATATAACTACTCCTAATA | 109 | 1981 |
| 1102457 | N/A | N/A | 27887 | 27906 | AAAAATATAACTACTCCTAA | 120 | 1982 |
| 1102458 | N/A | N/A | 27893 | 27912 | AGGAGTAAAAATATAACTAC | 117 | 1983 |
| 1102459 | N/A | N/A | 27894 | 27913 | CAGGAGTAAAAATATAACTA | 109 | 1984 |
| 1102460 | N/A | N/A | 27895 | 27914 | CCAGGAGTAAAAATATAACT | 91 | 1985 |
| 1102461 | N/A | N/A | 27903 | 27922 | TAAAATAACCAGGAGTAAAA | 88 | 1986 |
| 1102462 | N/A | N/A | 27908 | 27927 | CCAAATAAAATAACCAGGAG | 86 | 1987 |
| 1102463 | N/A | N/A | 27910 | 27929 | AACCAAATAAAATAACCAGG | 89 | 1988 |
| 1102464 | N/A | N/A | 27916 | 27935 | TGTTGAAACCAAATAAAATA | 108 | 1989 |
| 1102465 | N/A | N/A | 27943 | 27962 | CCACAATTTACTATTGTGTT | 96 | 1990 |
| 1102466 | N/A | N/A | 27947 | 27966 | AAAACCACAATTTACTATTG | 94 | 1991 |
| 1102467 | N/A | N/A | 27953 | 27972 | AAGATTAAAACCACAATTTA | 89 | 1992 |
| 1102468 | N/A | N/A | 27966 | 27985 | ACTGATACCCACAAAGATTA | 77 | 1993 |
| 1102469 | N/A | N/A | 27974 | 27993 | AAGGGTCAACTGATACCCAC | 89 | 1994 |
| 1102470 | N/A | N/A | 28007 | 28026 | ATGGCACATATTTATGTAAC | 51 | 1995 |
| 1102471 | N/A | N/A | 28083 | 28102 | AGTTGCATAGCCAATAAATG | 54 | 1996 |
| 1102472 | N/A | N/A | 28126 | 28145 | TATCACTAAAAAACTGGGCC | 100 | 1997 |
| 1102473 | N/A | N/A | 28127 | 28146 | ATATCACTAAAAAACTGGGC | 79 | 1998 |
| 1102474 | N/A | N/A | 28128 | 28147 | TATATCACTAAAAAACTGGG | 94 | 1999 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102475 | N/A | N/A | 28129 | 28148 | TTATATCACTAAAAAACTGG | 102 | 2000 |
| 1102476 | N/A | N/A | 28131 | 28150 | GTTTATATCACTAAAAAACT | 90 | 2001 |
| 1102477 | N/A | N/A | 28132 | 28151 | AGTTTATATCACTAAAAAAC | 146 | 2002 |
| 1102478 | N/A | N/A | 28133 | 28152 | TAGTTTATATCACTAAAAAA | 87 | 2003 |
| 1102479 | N/A | N/A | 28134 | 28153 | ATAGTTTATATCACTAAAAA | 101 | 2004 |
| 1102480 | N/A | N/A | 28136 | 28155 | TGATAGTTTATATCACTAAA | 99 | 2005 |
| 1102481 | N/A | N/A | 28138 | 28157 | ATTGATAGTTTATATCACTA | 94 | 2006 |
| 1102483 | N/A | N/A | 28195 | 28214 | TGTCTTAACATTTTCTTTG | 47 | 2007 |
| 1102485 | N/A | N/A | 28229 | 28248 | CACTTCAAACTTTTAATTAA | 94 | 2008 |
| 1102486 | N/A | N/A | 28230 | 28249 | CCACTTCAAACTTTTAATTA | 80 | 2009 |
| 1102487 | N/A | N/A | 28233 | 28252 | AACCCACTTCAAACTTTTAA | 75 | 2010 |
| 1102488 | N/A | N/A | 28235 | 28254 | AAAACCCACTTCAAACTTTT | 83 | 2011 |
| 1102489 | N/A | N/A | 28271 | 28290 | AAGCAAATACATATGAGTTA | 59 | 2012 |
| 1102490 | N/A | N/A | 28273 | 28292 | AGAAGCAAATACATATGAGT | 24 | 2013 |
| 1102491 | N/A | N/A | 28274 | 28293 | TAGAAGCAAATACATATGAG | 83 | 2014 |
| 1102492 | N/A | N/A | 28288 | 28307 | ATTTCATTAGAAAGTAGAAG | 98 | 2015 |
| 1102493 | N/A | N/A | 28293 | 28312 | AAATAATTTCATTAGAAAGT | 97 | 2016 |
| 1102494 | N/A | N/A | 28297 | 28316 | TGATAAATAATTTCATTAGA | 95 | 2017 |
| 1102495 | N/A | N/A | 28340 | 28359 | TTAATGAAATTTCAATTTTA | 110 | 2018 |
| 1102496 | N/A | N/A | 28351 | 28370 | TAATCTTCCCATTAATGAAA | 85 | 2019 |
| 1102497 | N/A | N/A | 28355 | 28374 | AAAATAATCTTCCCATTAAT | 83 | 2020 |
| 1102498 | N/A | N/A | 28360 | 28379 | GGATAAAAATAATCTTCCCA | 79 | 2021 |
| 1102499 | N/A | N/A | 28361 | 28380 | AGGATAAAAATAATCTTCCC | 62 | 2022 |
| 1102500 | N/A | N/A | 28378 | 28397 | AGAGGCAAGAAAAGTTCAGG | 54 | 2023 |
| 1102501 | N/A | N/A | 28414 | 28433 | GATTGCACACCATATGGAGT | 63 | 2024 |
| 1102502 | N/A | N/A | 28431 | 28450 | CTATTAATCAAAATGGGAT | 119 | 2025 |
| 1102503 | N/A | N/A | 28432 | 28451 | TCTATTAATCAAAATGGGA | 79 | 2026 |
| 1102504 | N/A | N/A | 28434 | 28453 | ACTCTATTAATCAAAATGG | 80 | 2027 |
| 1102505 | N/A | N/A | 28437 | 28456 | AGGACTCTATTAATCAAAAA | 77 | 2028 |
| 1102506 | N/A | N/A | 28439 | 28458 | GCAGGACTCTATTAATCAAA | 105 | 2029 |
| 1102507 | N/A | N/A | 28452 | 28471 | CCCTGCTAATCCAGCAGGAC | 130 | 2030 |
| 1102508 | N/A | N/A | 28477 | 28496 | AAAGAAATCTAAAGCTGATT | 115 | 2031 |
| 1102509 | N/A | N/A | 28810 | 28829 | AGAATATTCTACTCTTCTGG | 111 | 2032 |
| 1102510 | N/A | N/A | 28813 | 28832 | TTAAGAATATTCTACTCTTC | 103 | 2033 |
| 1102511 | N/A | N/A | 28817 | 28836 | CTCTTTAAGAATATTCTACT | 65 | 2034 |
| 1102512 | N/A | N/A | 28818 | 28837 | TCTCTTTAAGAATATTCTAC | 80 | 2035 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102513 | N/A | N/A | 28872 | 28891 | TTCAAGCAACAATATGTTTG | 86 | 2036 |
| 1102514 | N/A | N/A | 28880 | 28899 | TTTACCAATTCAAGCAACAA | 109 | 2037 |
| 1102515 | N/A | N/A | 28881 | 28900 | ATTTACCAATTCAAGCAACA | 128 | 2038 |
| 1102516 | N/A | N/A | 28883 | 28902 | GTATTTACCAATTCAAGCAA | 67 | 2039 |
| 1102517 | N/A | N/A | 28886 | 28905 | ACTGTATTTACCAATTCAAG | 86 | 2040 |
| 1102519 | N/A | N/A | 28895 | 28914 | AAACCAATCACTGTATTTAC | 126 | 2041 |
| 1102521 | N/A | N/A | 28902 | 28921 | ACAACAAAACCAATCACTG | 100 | 2042 |
| 1102522 | N/A | N/A | 28903 | 28922 | CACAACAAAACCAATCACT | 78 | 2043 |
| 1102523 | N/A | N/A | 28922 | 28941 | ACCTGAAAACAAAACACAAC | 95 | 2044 |
| 1102524 | N/A | N/A | 28923 | 28942 | TACCTGAAAACAAAACACAA | 25 | 2045 |
| 1102525 | N/A | N/A | 28926 | 28945 | AACTACCTGAAAACAAAACA | 78 | 2046 |
| 1102526 | N/A | N/A | 29022 | 29041 | TTTACTTTTCAAAGTAGGCT | 82 | 2047 |
| 1102527 | N/A | N/A | 29023 | 29042 | CTTTACTTTTCAAAGTAGGC | 109 | 2048 |
| 1102528 | N/A | N/A | 29025 | 29044 | TACTTTACTTTTCAAAGTAG | 109 | 2049 |
| 1102529 | N/A | N/A | 29028 | 29047 | AACTACTTTACTTTTCAAAG | 99 | 2050 |
| 1102530 | N/A | N/A | 29032 | 29051 | TACCAACTACTTTACTTTTC | 85 | 2051 |
| 1102531 | N/A | N/A | 29035 | 29054 | TTGTACCAACTACTTTACTT | 88 | 2052 |
| 1102532 | N/A | N/A | 29051 | 29070 | AACATGCTACTTTAACTTGT | 78 | 2053 |
| 1102533 | N/A | N/A | 29062 | 29081 | AGCAAATATTAAACATGCTA | 109 | 2054 |
| 1102534 | N/A | N/A | 29074 | 29093 | CAAAATAGCCAAAGCAAATA | 82 | 2055 |
| 1102535 | N/A | N/A | 29076 | 29095 | GACAAAATAGCCAAAGCAAA | 62 | 2056 |
| 1102536 | N/A | N/A | 29085 | 29104 | TTACAAATAGACAAAATAGC | 76 | 2057 |
| 1102537 | N/A | N/A | 29091 | 29110 | AACCATTTACAAATAGACAA | 63 | 2058 |
| 1102538 | N/A | N/A | 29096 | 29115 | GCAGTAACCATTTACAAATA | 42 | 2059 |
| 1102539 | N/A | N/A | 29119 | 29138 | ATTCAAATATTCACAGGATT | 55 | 2060 |
| 1102540 | N/A | N/A | 29125 | 29144 | AAATACATTCAAATATTCAC | 89 | 2061 |
| 1102541 | N/A | N/A | 29476 | 29495 | GCCGTAAATTTTATTTTTA | 16 | 2062 |
| 1102542 | N/A | N/A | 29477 | 29496 | TGCCGTAAATTTTATTTTT | 40 | 2063 |
| 1102543 | N/A | N/A | 29529 | 29548 | GTTAAAAAATTTATCCAGT | 82 | 2064 |
| 1102544 | N/A | N/A | 29530 | 29549 | AGTTTAAAAAATTATCCAG | 88 | 2065 |
| 1102545 | N/A | N/A | 29531 | 29550 | CAGTTTAAAAAATTTATCCA | 109 | 2066 |
| 1102546 | N/A | N/A | 29535 | 29554 | CACTCAGTTTAAAAAATTTA | 78 | 2067 |
| 1102547 | N/A | N/A | 29548 | 29567 | ATAAGGTTCCTTCACTCAG | 22 | 2068 |
| 1102548 | N/A | N/A | 29561 | 29580 | TAAATGAAATTTTATAAGGT | 109 | 2069 |
| 1102549 | N/A | N/A | 29585 | 29604 | GTCCTAATTTCATTTTCTT | 30 | 2070 |
| 1102550 | N/A | N/A | 29587 | 29606 | TTGTCCTAATTTCATTTTTC | 58 | 2071 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102551 | N/A | N/A | 29645 | 29664 | AGGGTTAATCAGGTAAGCAA | 8 | 2072 |
| 1102552 | N/A | N/A | 29647 | 29666 | GCAGGGTTAATCAGGTAAGC | 17 | 2073 |
| 1102553 | N/A | N/A | 29807 | 29826 | TTGATCCAGATTTATGGTTT | 28 | 2074 |
| 1102555 | N/A | N/A | 29812 | 29831 | AGGAGTTGATCCAGATTTAT | 28 | 2075 |
| 1102557 | N/A | N/A | 29881 | 29900 | AATGTATTTTCATATGGTGG | 10 | 2076 |
| 1102558 | N/A | N/A | 29901 | 29920 | AATGATAGTTACTTGAAAAG | 87 | 2077 |
| 1102559 | N/A | N/A | 30269 | 30288 | TCTTGTAATCTTTAACATGA | 84 | 2078 |
| 1102560 | N/A | N/A | 30280 | 30299 | CTGATTATTTATCTTGTAAT | 34 | 2079 |
| 1102561 | N/A | N/A | 30281 | 30300 | TCTGATTATTTATCTTGTAA | 34 | 2080 |
| 1102562 | N/A | N/A | 30282 | 30301 | GTCTGATTATTTATCTTGTA | 14 | 2081 |
| 1102563 | N/A | N/A | 30283 | 30302 | GGTCTGATTATTTATCTTGT | 15 | 2082 |
| 1102564 | N/A | N/A | 30350 | 30369 | TGGATGAAATACAGCAAATA | 42 | 2083 |
| 1102565 | N/A | N/A | 30354 | 30373 | AGAATGGATGAAATACAGCA | 82 | 2084 |
| 1102566 | N/A | N/A | 30376 | 30395 | AATGTGAAACTATGTGCATC | 57 | 2085 |
| 1102567 | N/A | N/A | 30378 | 30397 | GAAATGTGAAACTATGTGCA | 29 | 2086 |
| 1102568 | N/A | N/A | 30380 | 30399 | TTGAAATGTGAAACTATGTG | 58 | 2087 |
| 1102569 | N/A | N/A | 30398 | 30417 | TTCTCAATTTCAGAGACATT | 46 | 2088 |
| 1102570 | N/A | N/A | 30399 | 30418 | CTTCTCAATTTCAGAGACAT | 38 | 2089 |
| 1102571 | N/A | N/A | 30400 | 30419 | GCTTCTCAATTTCAGAGACA | 37 | 2090 |
| 1102572 | N/A | N/A | 30436 | 30455 | GTGCTGCTAATATACTGTCA | 26 | 2091 |
| 1102573 | N/A | N/A | 30452 | 30471 | GAGCCAATATTTATAGGTGC | 21 | 2092 |
| 1102574 | N/A | N/A | 30453 | 30472 | TGAGCCAATATTTATAGGTG | 7 | 2093 |
| 1102575 | N/A | N/A | 30473 | 30492 | TTATACCATCAAATGTAAAA | 83 | 2094 |
| 1102576 | N/A | N/A | 30475 | 30494 | CATTATACCATCAAATGTAA | 59 | 2095 |
| 1102577 | N/A | N/A | 30477 | 30496 | TTCATTATACCATCAAATGT | 53 | 2096 |
| 1102578 | N/A | N/A | 30478 | 30497 | CTTCATTATACCATCAAATG | 30 | 2097 |
| 1102579 | N/A | N/A | 30479 | 30498 | TCTTCATTATACCATCAAAT | 9 | 2098 |
| 1102580 | N/A | N/A | 30490 | 30509 | GGTAAATATTTTCTTCATTA | 9 | 2099 |
| 1102581 | N/A | N/A | 30495 | 30514 | AAAAAGGTAAATATTTTCTT | 84 | 2100 |
| 1102582 | N/A | N/A | 30520 | 30539 | GTTGTGACTTAAAAACAAAA | 74 | 2101 |
| 1102583 | N/A | N/A | 30523 | 30542 | TGAGTTGTGACTTAAAAACA | 49 | 2102 |
| 1102584 | N/A | N/A | 30546 | 30565 | CAGAATTTTCCTTCATCTAC | 89 | 2103 |
| 1102585 | N/A | N/A | 30547 | 30566 | TCAGAATTTTCCTTCATCTA | 42 | 2104 |
| 1102586 | N/A | N/A | 30548 | 30567 | ATCAGAATTTTCCTTCATCT | 34 | 2105 |
| 1102587 | N/A | N/A | 30574 | 30593 | ATCTCACATTAAGAGGATGT | 69 | 2106 |
| 1102588 | N/A | N/A | 30576 | 30595 | ATATCTCACATTAAGAGGAT | 69 | 2107 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102589 | N/A | N/A | 30577 | 30596 | AATATCTCACATTAAGAGGA | 41 | 2108 |
| 1102591 | N/A | N/A | 30582 | 30601 | CTAGAAATATCTCACATTAA | 88 | 2109 |
| 1102593 | N/A | N/A | 30587 | 30606 | AAAGACTAGAAATATCTCAC | 46 | 2110 |
| 1102594 | N/A | N/A | 30588 | 30607 | TAAAGACTAGAAATATCTCA | 65 | 2111 |
| 1102595 | N/A | N/A | 30600 | 30619 | ATCTATACTGAATAAAGACT | 72 | 2112 |
| 1102596 | N/A | N/A | 30605 | 30624 | CATTAATCTATACTGAATAA | 98 | 2113 |
| 1102597 | N/A | N/A | 30606 | 30625 | CCATTAATCTATACTGAATA | 64 | 2114 |
| 1102598 | N/A | N/A | 30607 | 30626 | GCCATTAATCTATACTGAAT | 19 | 2115 |
| 1102599 | N/A | N/A | 30608 | 30627 | AGCCATTAATCTATACTGAA | 7 | 2116 |
| 1102600 | N/A | N/A | 30609 | 30628 | TAGCCATTAATCTATACTGA | 25 | 2117 |
| 1102601 | N/A | N/A | 30610 | 30629 | TTAGCCATTAATCTATACTG | 80 | 2118 |
| 1102602 | N/A | N/A | 30611 | 30630 | ATTAGCCATTAATCTATACT | 65 | 2119 |
| 1102603 | N/A | N/A | 30613 | 30632 | TAATTAGCCATTAATCTATA | 66 | 2120 |
| 1102604 | N/A | N/A | 30614 | 30633 | ATAATTAGCCATTAATCTAT | 69 | 2121 |
| 1102605 | N/A | N/A | 30616 | 30635 | ATATAATTAGCCATTAATCT | 63 | 2122 |
| 1102606 | N/A | N/A | 30625 | 30644 | AAATTTAACATATAATTAGC | 89 | 2123 |
| 1102607 | N/A | N/A | 30632 | 30651 | TACTTTGAAATTTAACATAT | 92 | 2124 |
| 1102608 | N/A | N/A | 30651 | 30670 | AAAAAGCACTAATAAGCACT | 59 | 2125 |
| 1102609 | N/A | N/A | 30659 | 30678 | TTAAAAGTAAAAGCACTAA | 91 | 2126 |
| 1102610 | N/A | N/A | 30675 | 30694 | AAGTTAATTTTGAAACTTAA | 118 | 2127 |
| 1102611 | N/A | N/A | 30697 | 30716 | TTTGGAGTTTATTATAATAA | 55 | 2128 |
| 1102612 | N/A | N/A | 30723 | 30742 | TGCTAGTTTTCTACTTTTG | 13 | 2129 |
| 1102613 | N/A | N/A | 31103 | 31122 | ATGGGAGTATTATAAAACGA | 38 | 2130 |
| 1102614 | N/A | N/A | 31121 | 31140 | CAGTGGAAAGAATGGGAGAT | 48 | 2131 |
| 1102615 | N/A | N/A | 31147 | 31166 | AAAATAATCCAAACTTGCAG | 36 | 2132 |
| 1102616 | N/A | N/A | 31150 | 31169 | TACAAAATAATCCAAACTTG | 84 | 2133 |
| 1102617 | N/A | N/A | 31152 | 31171 | GTTACAAAATAATCCAAACT | 71 | 2134 |
| 1102618 | N/A | N/A | 31153 | 31172 | TGTTACAAAATAATCCAAAC | 82 | 2135 |
| 1102619 | N/A | N/A | 31154 | 31173 | TTGTTACAAAATAATCCAAA | 80 | 2136 |
| 1102620 | N/A | N/A | 31179 | 31198 | TATAGAATAATATGATGATT | 81 | 2137 |
| 1102621 | N/A | N/A | 31197 | 31216 | GACACATATTAAAATGGTTA | 25 | 2138 |
| 1102622 | N/A | N/A | 31237 | 31256 | GCATTTAACTATGTTAAAAA | 77 | 2139 |
| 1102623 | N/A | N/A | 31238 | 31257 | AGCATTTAACTATGTTAAAA | 88 | 2140 |
| 1102624 | N/A | N/A | 31240 | 31259 | ATAGCATTTAACTATGTTAA | 85 | 2141 |
| 1102625 | N/A | N/A | 31251 | 31270 | ATTTTATGACAATAGCATTT | 28 | 2142 |
| 1102627 | N/A | N/A | 31285 | 31304 | TGATATAGAATTACAATTAA | 112 | 2143 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102629 | N/A | N/A | 31647 | 31666 | AAGTAGATTTAAGTTATTTT | 118 | 2144 |
| 1102630 | N/A | N/A | 31650 | 31669 | ATTAAGTAGATTTAAGTTAT | 136 | 2145 |
| 1102631 | N/A | N/A | 31657 | 31676 | TTTTCTAATTAAGTAGATTT | 95 | 2146 |
| 1102632 | N/A | N/A | 31659 | 31678 | GTTTTTCTAATTAAGTAGAT | 103 | 2147 |
| 1102633 | N/A | N/A | 31660 | 31679 | AGTTTTTCTAATTAAGTAGA | 72 | 2148 |
| 1102634 | N/A | N/A | 31662 | 31681 | TTAGTTTTTCTAATTAAGTA | 123 | 2149 |
| 1102635 | N/A | N/A | 31664 | 31683 | TGTTAGTTTTTCTAATTAAG | 73 | 2150 |
| 1102636 | N/A | N/A | 32030 | 32049 | TGCTTTAATTTCTATATTTC | 71 | 2151 |
| 1102637 | N/A | N/A | 32676 | 32695 | GCCAAAATACTAACATCAGT | 110 | 2152 |
| 1102638 | N/A | N/A | 32677 | 32696 | TGCCAAAATACTAACATCAG | 42 | 2153 |
| 1102639 | N/A | N/A | 32678 | 32697 | GTGCCAAAATACTAACATCA | 26 | 2154 |
| 1102640 | N/A | N/A | 32679 | 32698 | TGTGCCAAAATACTAACATC | 52 | 2155 |
| 1102641 | N/A | N/A | 32680 | 32699 | ATGTGCCAAAATACTAACAT | 42 | 2156 |
| 1102642 | N/A | N/A | 32682 | 32701 | GAATGTGCCAAAATACTAAC | 36 | 2157 |
| 1102643 | N/A | N/A | 32683 | 32702 | AGAATGTGCCAAAATACTAA | 47 | 2158 |
| 1102644 | N/A | N/A | 32691 | 32710 | ACAGAAAAGAATGTGCCAA | 48 | 2159 |
| 1102645 | N/A | N/A | 32726 | 32745 | GAGTACAACACTTACAAGGT | 24 | 2160 |
| 1102646 | N/A | N/A | 32750 | 32769 | AGACTATTTACTGTCATAGG | 15 | 2161 |
| 1102647 | N/A | N/A | 32752 | 32771 | AAAGACTATTTACTGTCATA | 54 | 2162 |
| 1102648 | N/A | N/A | 32754 | 32773 | ACAAAGACTATTTACTGTCA | 44 | 2163 |
| 1102649 | N/A | N/A | 32762 | 32781 | AGCCTGTTACAAAGACTATT | 64 | 2164 |
| 1102650 | N/A | N/A | 32777 | 32796 | TATGAAATATCATGCAGCCT | 47 | 2165 |
| 1102651 | N/A | N/A | 32778 | 32797 | TTATGAAATATCATGCAGCC | 63 | 2166 |
| 1102652 | N/A | N/A | 32786 | 32805 | CATTCATTTTATGAAATATC | 93 | 2167 |
| 1102653 | N/A | N/A | 32807 | 32826 | ACATATAAATTATGCCACAT | 49 | 2168 |
| 1102654 | N/A | N/A | 32826 | 32845 | AGCAGAATTCAAAAGGCTCA | 65 | 2169 |
| 1102655 | N/A | N/A | 32864 | 32883 | GCAATATAAGAATTGTTCAT | 19 | 2170 |
| 1102656 | N/A | N/A | 32933 | 32952 | TCCTTTAACCCAATAATCTG | 91 | 2171 |
| 1102657 | N/A | N/A | 32940 | 32959 | GTTCATATCCTTTAACCCAA | 8 | 2172 |
| 1102658 | N/A | N/A | 32975 | 32994 | AGCAATTTAGAAATCTGTTC | 68 | 2173 |
| 1102659 | N/A | N/A | 32993 | 33012 | ATGGGAATTATTCTGGAAAG | 40 | 2174 |
| 1102660 | N/A | N/A | 33005 | 33024 | TGAAAGTATCACATGGGAAT | 39 | 2175 |
| 1102661 | N/A | N/A | 33013 | 33032 | AAACATGGTGAAAGTATCAC | 33 | 2176 |
| 1102663 | N/A | N/A | 33370 | 33389 | GATGTATGTCTTTAGACCAT | 25 | 2177 |
| 1102665 | N/A | N/A | 33447 | 33466 | GCAGTTTATTTTTATGCTTT | 40 | 2178 |
| 1102666 | N/A | N/A | 33492 | 33511 | GTTTCATATTTTTAATCCAG | 7 | 2179 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102667 | N/A | N/A | 33497 | 33516 | TGGAAGTTTCATATTTTAA | 14 | 2180 |
| 1102668 | N/A | N/A | 33498 | 33517 | TTGGAAGTTTCATATTTTA | 18 | 2181 |
| 1102669 | N/A | N/A | 33875 | 33894 | ACTTACTTAGTCATTATTGG | 27 | 2182 |
| 1102670 | N/A | N/A | 33880 | 33899 | TTATAACTTACTTAGTCATT | 55 | 2183 |
| 1102671 | N/A | N/A | 33882 | 33901 | TGTTATAACTTACTTAGTCA | 27 | 2184 |
| 1102672 | N/A | N/A | 33884 | 33903 | CTTGTTATAACTTACTTAGT | 48 | 2185 |
| 1102673 | N/A | N/A | 33921 | 33940 | TGTTTACTAAAAGCACTAG | 94 | 2186 |
| 1102674 | N/A | N/A | 33922 | 33941 | CTGTTTACTAAAAGCACTA | 102 | 2187 |
| 1102675 | N/A | N/A | 33923 | 33942 | CCTGTTTACTAAAAGCACT | 105 | 2188 |
| 1102676 | N/A | N/A | 33925 | 33944 | ACCCTGTTTACTAAAAGCA | 110 | 2189 |
| 1102677 | N/A | N/A | 33956 | 33975 | GAACATTTTTAAAAGGGTAC | 13 | 2190 |
| 1102678 | N/A | N/A | 33957 | 33976 | CGAACATTTTTAAAAGGGTA | 15 | 2191 |
| 1102679 | N/A | N/A | 33959 | 33978 | TTCGAACATTTTTAAAAGGG | 22 | 2192 |
| 1102680 | N/A | N/A | 33973 | 33992 | GAGGTATATCGATATTCGAA | 41 | 2193 |
| 1102681 | N/A | N/A | 33993 | 34012 | ATCCTCCACCAAGTAGGAAG | 78 | 2194 |
| 1102682 | N/A | N/A | 34001 | 34020 | CTCAATCAATCCTCCACCAA | 97 | 2195 |
| 1102683 | N/A | N/A | 34014 | 34033 | GCACACTTTCCTCCTCAATC | 15 | 2196 |
| 1102684 | N/A | N/A | 34030 | 34049 | GCTGGTAACCATCACTGCAC | 12 | 2197 |
| 1102685 | N/A | N/A | 34031 | 34050 | AGCTGGTAACCATCACTGCA | 79 | 2198 |
| 1102686 | N/A | N/A | 34051 | 34070 | AAGTCAAGCCAAGAGGCTGA | 88 | 2199 |
| 1102687 | N/A | N/A | 34053 | 34072 | CAAAGTCAAGCCAAGAGGCT | 83 | 2200 |
| 1102688 | N/A | N/A | 34058 | 34077 | ATTTGCAAAGTCAAGCCAAG | 55 | 2201 |
| 1102689 | N/A | N/A | 34071 | 34090 | AATTCTCACCAGTATTTGCA | 45 | 2202 |
| 1102690 | N/A | N/A | 34082 | 34101 | AGCTCTTTCCAAATTCTCAC | 24 | 2203 |
| 1102691 | N/A | N/A | 34095 | 34114 | TAAGATATTCTCAAGCTCTT | 40 | 2204 |
| 1102692 | N/A | N/A | 34097 | 34116 | TGTAAGATATTCTCAAGCTC | 29 | 2205 |
| 1102693 | N/A | N/A | 34100 | 34119 | CTATGTAAGATATTCTCAAG | 58 | 2206 |
| 1102694 | N/A | N/A | 34102 | 34121 | GACTATGTAAGATATTCTCA | 31 | 2207 |
| 1102695 | N/A | N/A | 34111 | 34130 | GCAACATGTGACTATGTAAG | 16 | 2208 |
| 1102696 | N/A | N/A | 34130 | 34149 | TAGTTCTTAACTCTTCTCAG | 34 | 2209 |
| 1102697 | N/A | N/A | 34133 | 34152 | AGTTAGTTCTTAACTCTTCT | 39 | 2210 |
| 1102699 | N/A | N/A | 34147 | 34166 | AATGAACATCAAGAAGTTAG | 54 | 2211 |
| 1102701 | N/A | N/A | 34228 | 34247 | AATTTTAGTGAAAGGCAAAT | 84 | 2212 |
| 1102702 | N/A | N/A | 34235 | 34254 | AATCAGGAATTTTAGTGAAA | 53 | 2213 |
| 1102703 | N/A | N/A | 34241 | 34260 | CTAAGTAATCAGGAATTTTA | 106 | 2214 |
| 1102704 | N/A | N/A | 34277 | 34296 | AAAGACAGAACCTAGAGAGA | 83 | 2215 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102705 | N/A | N/A | 34287 | 34306 | CCAAGCTCCCAAAGACAGAA | 52 | 2216 |
| 1102706 | N/A | N/A | 34304 | 34323 | GCTTGATAACCTTAGACCCA | 37 | 2217 |
| 1102707 | N/A | N/A | 34402 | 34421 | CAAATACTCAAAAAGGGAAA | 47 | 2218 |
| 1102708 | N/A | N/A | 34403 | 34422 | TCAAATACTCAAAAAGGGAA | 75 | 2219 |
| 1102709 | N/A | N/A | 34405 | 34424 | CTTCAAATACTCAAAAAGGG | 107 | 2220 |
| 1102710 | N/A | N/A | 34406 | 34425 | GCTTCAAATACTCAAAAAGG | 45 | 2221 |
| 1102711 | N/A | N/A | 34407 | 34426 | AGCTTCAAATACTCAAAAAG | 69 | 2222 |
| 1102712 | N/A | N/A | 34411 | 34430 | ATGAAGCTTCAAATACTCAA | 71 | 2223 |
| 1102713 | N/A | N/A | 34424 | 34443 | TACTATATTCAGTATGAAGC | 33 | 2224 |
| 1102714 | N/A | N/A | 34425 | 34444 | TTACTATATTCAGTATGAAG | 59 | 2225 |
| 1102715 | N/A | N/A | 34427 | 34446 | GATTACTATATTCAGTATGA | 48 | 2226 |
| 1102716 | N/A | N/A | 34429 | 34448 | ATGATTACTATATTCAGTAT | 52 | 2227 |
| 1102717 | N/A | N/A | 34431 | 34450 | CTATGATTACTATATTCAGT | 31 | 2228 |
| 1102718 | N/A | N/A | 34432 | 34451 | ACTATGATTACTATATTCAG | 38 | 2229 |
| 1102719 | N/A | N/A | 34433 | 34452 | TACTATGATTACTATATTCA | 65 | 2230 |
| 1102720 | N/A | N/A | 34436 | 34455 | GAATACTATGATTACTATAT | 37 | 2231 |
| 1102721 | N/A | N/A | 34437 | 34456 | TGAATACTATGATTACTATA | 89 | 2232 |
| 1102722 | N/A | N/A | 34440 | 34459 | GCATGAATACTATGATTACT | 6 | 2233 |
| 1102723 | N/A | N/A | 34455 | 34474 | TATGATTTTCTTTATGCATG | 9 | 2234 |
| 1102724 | N/A | N/A | 34456 | 34475 | TTATGATTTTCTTTATGCAT | 29 | 2235 |
| 1102725 | N/A | N/A | 34465 | 34484 | GCAATTACTTTATGATTTTC | 12 | 2236 |
| 1102726 | N/A | N/A | 34467 | 34486 | ATGCAATTACTTTATGATTT | 15 | 2237 |
| 1102727 | N/A | N/A | 34468 | 34487 | TATGCAATTACTTTATGATT | 62 | 2238 |
| 1102728 | N/A | N/A | 34469 | 34488 | TTATGCAATTACTTTATGAT | 72 | 2239 |
| 1102729 | N/A | N/A | 34470 | 34489 | TTTATGCAATTACTTTATGA | 100 | 2240 |
| 1102730 | N/A | N/A | 34486 | 34505 | ATGATTACTTTATGCATTTA | 91 | 2241 |
| 1102731 | N/A | N/A | 34488 | 34507 | CTATGATTACTTTATGCATT | 57 | 2242 |
| 1102732 | N/A | N/A | 34493 | 34512 | GAAAACTATGATTACTTTAT | 83 | 2243 |
| 1102733 | N/A | N/A | 34494 | 34513 | TGAAAACTATGATTACTTTA | 65 | 2244 |
| 1102735 | N/A | N/A | 34498 | 34517 | TGCATGAAAACTATGATTAC | 59 | 2245 |
| 1102737 | N/A | N/A | 34511 | 34530 | CTAGTTTTTTAATGCATGA | 34 | 2246 |
| 1102738 | N/A | N/A | 34512 | 34531 | ACTAGTTTTTTAATGCATG | 76 | 2247 |
| 1102739 | N/A | N/A | 34513 | 34532 | AACTAGTTTTTTAATGCAT | 74 | 2248 |
| 1102740 | N/A | N/A | 34851 | 34870 | ATAAATTATGAATCTGTAAT | 108 | 2249 |
| 1102741 | N/A | N/A | 34855 | 34874 | ACTCATAAATTATGAATCTG | 53 | 2250 |
| 1102742 | N/A | N/A | 34856 | 34875 | GACTCATAAATTATGAATCT | 86 | 2251 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102743 | N/A | N/A | 34857 | 34876 | TGACTCATAAATTATGAATC | 99 | 2252 |
| 1102744 | N/A | N/A | 34861 | 34880 | TTAATGACTCATAAATTATG | 101 | 2253 |
| 1102745 | N/A | N/A | 34877 | 34896 | GGCTTGAAAATATTATTTAA | 83 | 2254 |
| 1102746 | N/A | N/A | 34894 | 34913 | GCTGGAAAAAATGTCATGGC | 40 | 2255 |
| 1102747 | N/A | N/A | 34895 | 34914 | TGCTGGAAAAAATGTCATGG | 45 | 2256 |
| 1102748 | N/A | N/A | 34917 | 34936 | GTAAAACAGATTTAGAGACT | 68 | 2257 |
| 1102749 | N/A | N/A | 34919 | 34938 | TGGTAAAACAGATTTAGAGA | 36 | 2258 |
| 1102750 | N/A | N/A | 34971 | 34990 | GGTTTTACAGTGACACAGCT | 19 | 2259 |
| 1102751 | N/A | N/A | 35004 | 35023 | TTGCTTAATTTCATGCTTCT | 71 | 2260 |
| 1102752 | N/A | N/A | 35021 | 35040 | AAATAGTTTCACACACATTG | 27 | 2261 |
| 1102753 | N/A | N/A | 35023 | 35042 | TAAAATAGTTTCACACACAT | 63 | 2262 |
| 1102754 | N/A | N/A | 35025 | 35044 | TATAAAATAGTTTCACACAC | 69 | 2263 |
| 1102755 | N/A | N/A | 35061 | 35080 | AACTGCCAACATGTATGTAT | 42 | 2264 |
| 1102756 | N/A | N/A | 35094 | 35113 | CATTTCAAAGCCACACCTAG | 106 | 2265 |
| 1102757 | N/A | N/A | 35098 | 35117 | CATCCATTTCAAAGCCACAC | 44 | 2266 |
| 1102758 | N/A | N/A | 35174 | 35193 | TGTCCATGAAGATATTTGTG | 31 | 2267 |
| 1102759 | N/A | N/A | 35185 | 35204 | ATAGCAATCCATGTCCATGA | 10 | 2268 |
| 1102760 | N/A | N/A | 35186 | 35205 | CATAGCAATCCATGTCCATG | 22 | 2269 |
| 1102761 | N/A | N/A | 35187 | 35206 | TCATAGCAATCCATGTCCAT | 38 | 2270 |
| 1102762 | N/A | N/A | 35203 | 35222 | TTAGGCAATCAAACACTCAT | 73 | 2271 |
| 1102763 | N/A | N/A | 35240 | 35259 | TAAATTATACCATATCACTG | 88 | 2272 |
| 1102764 | N/A | N/A | 35243 | 35262 | TGATAAATTATACCATATCA | 110 | 2273 |
| 1102765 | N/A | N/A | 35247 | 35266 | TGTTTGATAAATTATACCAT | 79 | 2274 |
| 1102766 | N/A | N/A | 35264 | 35283 | TTTCTGTTTCTCAACACTGT | 77 | 2275 |
| 1102767 | N/A | N/A | 35286 | 35305 | CTCTTTAAAACATCCCCAGT | 95 | 2276 |
| 1102768 | N/A | N/A | 35290 | 35309 | TTTCCTCTTTAAAACATCCC | 37 | 2277 |
| 1102769 | N/A | N/A | 35321 | 35340 | TATGTAAACCCCTAATTTCT | 100 | 2278 |
| 1102771 | N/A | N/A | 35332 | 35351 | TTTCTTAAGATTATGTAAAC | 146 | 2279 |
| 1102773 | N/A | N/A | 35440 | 35459 | TTTAATATCCTCATTACCCA | 52 | 2280 |
| 1102774 | N/A | N/A | 35441 | 35460 | ATTTAATATCCTCATTACCC | 77 | 2281 |
| 1102775 | N/A | N/A | 35442 | 35461 | AATTTAATATCCTCATTACC | 71 | 2282 |
| 1102776 | N/A | N/A | 35446 | 35465 | CTTAAATTTAATATCCTCAT | 67 | 2283 |
| 1102777 | N/A | N/A | 35448 | 35467 | TTCTTAAATTTAATATCCTC | 75 | 2284 |
| 1102778 | N/A | N/A | 35450 | 35469 | TGTTCTTAAATTTAATATCC | 50 | 2285 |
| 1102779 | N/A | N/A | 35484 | 35503 | GCTTTCTATGCCAAGGATCA | 36 | 2286 |
| 1102780 | N/A | N/A | 35562 | 35581 | AGTCCCAAAATTCTGCTTCA | 127 | 2287 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102781 | N/A | N/A | 35566 | 35585 | TGCCAGTCCCAAAATTCTGC | 94 | 2288 |
| 1102782 | N/A | N/A | 35588 | 35607 | GCAAGCAAAGCCATTTGGGA | 80 | 2289 |
| 1102783 | N/A | N/A | 36442 | 36461 | CTAAAAATACAAACCTTGTC | 73 | 2290 |
| 1102784 | N/A | N/A | 36582 | 36601 | CATGAGCTTTAAAAAGCAGA | 153 | 2291 |
| 1102785 | N/A | N/A | 36603 | 36622 | TGGTTACAAATTAAGTGCTC | 79 | 2292 |
| 1102786 | N/A | N/A | 36604 | 36623 | CTGGTTACAAATTAAGTGCT | 64 | 2293 |
| 1102787 | N/A | N/A | 36606 | 36625 | TTCTGGTTACAAATTAAGTG | 37 | 2294 |
| 1102788 | N/A | N/A | 36624 | 36643 | ATTATTTTACAAGTAGGATT | 86 | 2295 |
| 1102789 | N/A | N/A | 36627 | 36646 | TAGATTATTTTACAAGTAGG | 15 | 2296 |
| 1102790 | N/A | N/A | 36628 | 36647 | TTAGATTATTTTACAAGTAG | 65 | 2297 |
| 1102791 | N/A | N/A | 36629 | 36648 | CTTAGATTATTTTACAAGTA | 55 | 2298 |
| 1102792 | N/A | N/A | 36634 | 36653 | CATGTCTTAGATTATTTTAC | 38 | 2299 |
| 1102793 | N/A | N/A | 36658 | 36677 | TAGAGGTTACAAAGCTAAAA | 31 | 2300 |
| 1102794 | N/A | N/A | 36670 | 36689 | CCATCAATATTATAGAGGTT | 7 | 2301 |
| 1102795 | N/A | N/A | 36734 | 36753 | TCCAGCTGTGAAGACACTGA | 103 | 2302 |
| 1102796 | N/A | N/A | 36757 | 36776 | ACCTTGAAACAATGTAGACA | 71 | 2303 |
| 1102797 | N/A | N/A | 36797 | 36816 | ACTTTTAGTTTATGAAAAAT | 96 | 2304 |
| 1102798 | N/A | N/A | 36799 | 36818 | CTACTTTTAGTTTATGAAAA | 105 | 2305 |
| 1102799 | N/A | N/A | 36804 | 36823 | TTATTCTACTTTTAGTTTAT | 75 | 2306 |
| 1102800 | N/A | N/A | 36807 | 36826 | CCTTTATTCTACTTTTAGTT | 53 | 2307 |
| 1102801 | N/A | N/A | 36808 | 36827 | GCCTTTATTCTACTTTTAGT | 22 | 2308 |
| 1102802 | N/A | N/A | 36811 | 36830 | ATAGCCTTTATTCTACTTTT | 17 | 2309 |
| 1102803 | N/A | N/A | 36815 | 36834 | AGGAATAGCCTTTATTCTAC | 57 | 2310 |
| 1102804 | N/A | N/A | 36817 | 36836 | AGAGGAATAGCCTTTATTCT | 51 | 2311 |
| 1102805 | N/A | N/A | 36830 | 36849 | AGATAGCAATTTTAGAGGAA | 30 | 2312 |
| 1102807 | N/A | N/A | 36973 | 36992 | CCCATTAGCAAATCCTGATG | 72 | 2313 |
| 1102809 | N/A | N/A | 37096 | 37115 | AGAAAGTTCAACTAATGAGA | 87 | 2314 |
| 1102810 | N/A | N/A | 37124 | 37143 | TTTTGTGTTTTAAAACTGTG | 61 | 2315 |
| 1102811 | N/A | N/A | 37153 | 37172 | TGGCACATTTTTTATAGAGT | 4 | 2316 |
| 1102812 | N/A | N/A | 37171 | 37190 | CAACAATTATTAATAGAATG | 81 | 2317 |
| 1102813 | N/A | N/A | 37172 | 37191 | GCAACAATTATTAATAGAAT | 77 | 2318 |
| 1102814 | N/A | N/A | 37173 | 37192 | AGCAACAATTATTAATAGAA | 109 | 2319 |
| 1102815 | N/A | N/A | 37174 | 37193 | CAGCAACAATTATTAATAGA | 48 | 2320 |
| 1102816 | N/A | N/A | 37176 | 37195 | ACCAGCAACAATTATTAATA | 55 | 2321 |
| 1102817 | N/A | N/A | 37177 | 37196 | TACCAGCAACAATTATTAAT | 106 | 2322 |
| 1102818 | N/A | N/A | 37185 | 37204 | TTTTAAATTACCAGCAACAA | 71 | 2323 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102819 | N/A | N/A | 37187 | 37206 | ATTTTTAAATTACCAGCAAC | 52 | 2324 |
| 1102820 | N/A | N/A | 37191 | 37210 | AAGGATTTTTAAATTACCAG | 35 | 2325 |
| 1102821 | N/A | N/A | 37194 | 37213 | AACAAGGATTTTTAAATTAC | 81 | 2326 |
| 1102822 | N/A | N/A | 37317 | 37336 | GCTGACAATCTCAGTGAGAA | 76 | 2327 |
| 1102823 | N/A | N/A | 37321 | 37340 | AACAGCTGACAATCTCAGTG | 58 | 2328 |
| 1102824 | N/A | N/A | 37330 | 37349 | AAACTTACAAACAGCTGACA | 66 | 2329 |
| 1102825 | N/A | N/A | 37332 | 37351 | CAAAACTTACAAACAGCTGA | 58 | 2330 |
| 1102826 | N/A | N/A | 37341 | 37360 | ACCAAAAACCAAAACTTACA | 89 | 2331 |
| 1102827 | N/A | N/A | 37342 | 37361 | AACCAAAAACCAAAACTTAC | 84 | 2332 |
| 1102828 | N/A | N/A | 37437 | 37456 | CTAAAAAACCCCAAATCTAA | 87 | 2333 |
| 1102829 | N/A | N/A | 37438 | 37457 | CCTAAAAAACCCCAAATCTA | 104 | 2334 |
| 1102830 | N/A | N/A | 37439 | 37458 | TCCTAAAAAACCCCAAATCT | 75 | 2335 |
| 1102831 | N/A | N/A | 37448 | 37467 | ATTCACAAATCCTAAAAAAC | 92 | 2336 |
| 1102832 | N/A | N/A | 37454 | 37473 | GCAAATATTCACAAATCCTA | 30 | 2337 |
| 1102833 | N/A | N/A | 37456 | 37475 | GTGCAAATATTCACAAATCC | 30 | 2338 |
| 1102834 | N/A | N/A | 37457 | 37476 | AGTGCAAATATTCACAAATC | 27 | 2339 |
| 1102835 | N/A | N/A | 37459 | 37478 | ATAGTGCAAATATTCACAAA | 33 | 2340 |
| 1102836 | N/A | N/A | 37535 | 37554 | CATGATACTCAAAAGAGGTG | 85 | 2341 |
| 1102837 | N/A | N/A | 37597 | 37616 | CATCCTAAATCCGAGAATCA | 100 | 2342 |
| 1102838 | N/A | N/A | 37601 | 37620 | CAAGCATCCTAAATCCGAGA | 90 | 2343 |
| 1102839 | N/A | N/A | 37618 | 37637 | AATCTGAAATTACAGGTCAA | 89 | 2344 |
| 1102840 | N/A | N/A | 37620 | 37639 | TAAATCTGAAATTACAGGTC | 90 | 2345 |
| 1102841 | N/A | N/A | 37633 | 37652 | TTCTGCTTTTATGTAAATCT | 20 | 2346 |
| 1102843 | N/A | N/A | 37711 | 37730 | CATATTATTCCCAAATGGTT | 53 | 2347 |
| 1102845 | N/A | N/A | 37762 | 37781 | ACTTAGAAAATATACACTGA | 82 | 2348 |
| 1102846 | N/A | N/A | 37764 | 37783 | GTACTTAGAAAATATACACT | 43 | 2349 |
| 1102847 | N/A | N/A | 37779 | 37798 | TAGGAATATATTCTTGTACT | 37 | 2350 |
| 1102848 | N/A | N/A | 37783 | 37802 | TATGTAGGAATATATTCTTG | 25 | 2351 |
| 1102849 | N/A | N/A | 37816 | 37835 | TAAAATGTTTAAACATGACG | 78 | 2352 |
| 1102850 | N/A | N/A | 37825 | 37844 | TCCCCATTTTAAAATGTTTA | 79 | 2353 |
| 1102851 | N/A | N/A | 37834 | 37853 | TAATACAAATCCCCATTTTA | 78 | 2354 |
| 1102852 | N/A | N/A | 37838 | 37857 | AATGTAATACAAATCCCCAT | 58 | 2355 |
| 1102853 | N/A | N/A | 37900 | 37919 | ATCAGATTTTAAGTAATACT | 85 | 2356 |
| 1102854 | N/A | N/A | 37903 | 37922 | ATTATCAGATTTTAAGTAAT | 87 | 2357 |
| 1102855 | N/A | N/A | 37906 | 37925 | CACATTATCAGATTTTAAGT | 69 | 2358 |
| 1102856 | N/A | N/A | 37907 | 37926 | ACACATTATCAGATTTTAAG | 48 | 2359 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102857 | N/A | N/A | 37908 | 37927 | CACACATTATCAGATTTTAA | 67 | 2360 |
| 1102858 | N/A | N/A | 37913 | 37932 | TTTAACACACATTATCAGAT | 67 | 2361 |
| 1102859 | N/A | N/A | 37917 | 37936 | ACTATTTAACACACATTATC | 85 | 2362 |
| 1102860 | N/A | N/A | 37919 | 37938 | CTACTATTTAACACACATTA | 65 | 2363 |
| 1102861 | N/A | N/A | 37922 | 37941 | AAACTACTATTTAACACACA | 60 | 2364 |
| 1102862 | N/A | N/A | 37923 | 37942 | AAAACTACTATTTAACACAC | 107 | 2365 |
| 1102863 | N/A | N/A | 37927 | 37946 | AATGAAAACTACTATTTAAC | 84 | 2366 |
| 1102864 | N/A | N/A | 38009 | 38028 | TATCTTACTCATCTATTTCC | 70 | 2367 |
| 1102865 | N/A | N/A | 38053 | 38072 | TATTTCCCTCTTTATGGCAT | 36 | 2368 |
| 1102866 | N/A | N/A | 38116 | 38135 | CCCATTATTTCATCACTTCA | 42 | 2369 |
| 1102867 | N/A | N/A | 38123 | 38142 | TGACATTCCCATTATTTCAT | 64 | 2370 |
| 1102868 | N/A | N/A | 38146 | 38165 | CCATCCCACCAAAAGTAGCC | 86 | 2371 |
| 1102869 | N/A | N/A | 38183 | 38202 | AGCTTAAAATTTATCTCCCC | 69 | 2372 |
| 1102870 | N/A | N/A | 38184 | 38203 | GAGCTTAAAATTTATCTCCC | 60 | 2373 |
| 1102871 | N/A | N/A | 38225 | 38244 | ATAATGTTTCCATGGCTGGC | 69 | 2374 |
| 1102872 | N/A | N/A | 38234 | 38253 | TGAGTTAACATAATGTTTCC | 45 | 2375 |
| 1102873 | N/A | N/A | 38236 | 38255 | TGTGAGTTAACATAATGTTT | 53 | 2376 |
| 1102874 | N/A | N/A | 38247 | 38266 | TCAAACTACCATGTGAGTTA | 93 | 2377 |
| 1102875 | N/A | N/A | 38251 | 38270 | CATTTCAAACTACCATGTGA | 101 | 2378 |
| 1102876 | N/A | N/A | 38252 | 38271 | GCATTTCAAACTACCATGTG | 46 | 2379 |
| 1102877 | N/A | N/A | 38255 | 38274 | AAAGCATTTCAAACTACCAT | 48 | 2380 |
| 1102879 | N/A | N/A | 38286 | 38305 | AGTCACCAAAAATAAGTACC | 66 | 2381 |
| 1102881 | N/A | N/A | 38294 | 38313 | TTGTTGAAAGTCACCAAAAA | 65 | 2382 |
| 1102882 | N/A | N/A | 38304 | 38323 | ACCCTTAATATTGTTGAAAG | 54 | 2383 |
| 1102883 | N/A | N/A | 38306 | 38325 | AGACCCTTAATATTGTTGAA | 53 | 2384 |
| 1102884 | N/A | N/A | 38311 | 38330 | TTTATAGACCCTTAATATTG | 82 | 2385 |
| 1102885 | N/A | N/A | 38357 | 38376 | TACAAAAGATTCACTGGTA | 59 | 2386 |
| 1102886 | N/A | N/A | 38359 | 38378 | CATACAAAAGATTCACTGG | 93 | 2387 |
| 1102887 | N/A | N/A | 38362 | 38381 | TATCATACAAAAGATTCAC | 70 | 2388 |
| 1102888 | N/A | N/A | 38364 | 38383 | CCTATCATACAAAAGATTC | 76 | 2389 |
| 1102889 | N/A | N/A | 38368 | 38387 | AAACCTATCATACAAAAG | 92 | 2390 |
| 1102890 | N/A | N/A | 38374 | 38393 | AAACAAAAACCTATCATAC | 105 | 2391 |
| 1102891 | N/A | N/A | 38681 | 38700 | AATAACCTATCATGGCCAGG | 66 | 2392 |
| 1102892 | N/A | N/A | 38686 | 38705 | CACAAAATAACCTATCATGG | 94 | 2393 |
| 1102893 | N/A | N/A | 38687 | 38706 | TCACAAAATAACCTATCATG | 70 | 2394 |
| 1102894 | N/A | N/A | 38689 | 38708 | CATCACAAAATAACCTATCA | 75 | 2395 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102895 | N/A | N/A | 38690 | 38709 | TCATCACAAAATAACCTATC | 81 | 2396 |
| 1102896 | N/A | N/A | 38691 | 38710 | TTCATCACAAAATAACCTAT | 65 | 2397 |
| 1102897 | N/A | N/A | 38692 | 38711 | TTTCATCACAAAATAACCTA | 64 | 2398 |
| 1102898 | N/A | N/A | 38715 | 38734 | CAGACAAATTAAGAGGTAGG | 21 | 2399 |
| 1102899 | N/A | N/A | 38717 | 38736 | ATCAGACAAATTAAGAGGTA | 47 | 2400 |
| 1102900 | N/A | N/A | 38718 | 38737 | TATCAGACAAATTAAGAGGT | 48 | 2401 |
| 1102901 | N/A | N/A | 38724 | 38743 | TAAATTTATCAGACAAATTA | 106 | 2402 |
| 1102902 | N/A | N/A | 38726 | 38745 | TTTAAATTTATCAGACAAAT | 90 | 2403 |
| 1102903 | N/A | N/A | 38727 | 38746 | ATTTAAATTTATCAGACAAA | 62 | 2404 |
| 1102904 | N/A | N/A | 38730 | 38749 | AAAATTTAAATTTATCAGAC | 102 | 2405 |
| 1102905 | N/A | N/A | 38732 | 38751 | ATAAAATTTAAATTTATCAG | 115 | 2406 |
| 1102906 | N/A | N/A | 38736 | 38755 | AGACATAAAATTTAAATTTA | 106 | 2407 |
| 1102907 | N/A | N/A | 38738 | 38757 | CTAGACATAAAATTTAAATT | 89 | 2408 |
| 1102908 | N/A | N/A | 38773 | 38792 | TACTTTAAAATATGGAAGTG | 85 | 2409 |
| 1102909 | N/A | N/A | 38777 | 38796 | AGATTACTTTAAAATATGGA | 108 | 2410 |
| 1102910 | N/A | N/A | 38785 | 38804 | TCTGATACAGATTACTTTAA | 66 | 2411 |
| 1102911 | N/A | N/A | 38787 | 38806 | AGTCTGATACAGATTACTTT | 54 | 2412 |
| 1102912 | N/A | N/A | 38812 | 38831 | GTATTAAAAGAATGCAAGAG | 57 | 2413 |
| 1102913 | N/A | N/A | 38817 | 38836 | CACTGGTATTAAAAGAATGC | 66 | 2414 |
| 1102915 | N/A | N/A | 38852 | 38871 | TAAGGAAAATACATTGTTTC | 80 | 2415 |
| 1102917 | N/A | N/A | 38868 | 38887 | TGAGAAAAACTATTCATAAG | 86 | 2416 |
| 1102918 | N/A | N/A | 38869 | 38888 | ATGAGAAAAACTATTCATAA | 97 | 2417 |
| 1102919 | N/A | N/A | 38872 | 38891 | ACCATGAGAAAAACTATTCA | 64 | 2418 |
| 1102920 | N/A | N/A | 38879 | 38898 | TAAATACACCATGAGAAAAA | 101 | 2419 |
| 1102921 | N/A | N/A | 38880 | 38899 | ATAAATACACCATGAGAAAA | 68 | 2420 |
| 1102922 | N/A | N/A | 38882 | 38901 | GAATAAATACACCATGAGAA | 98 | 2421 |
| 1102923 | N/A | N/A | 38884 | 38903 | AAGAATAAATACACCATGAG | 98 | 2422 |
| 1102924 | N/A | N/A | 38885 | 38904 | AAAGAATAAATACACCATGA | 81 | 2423 |
| 1102925 | N/A | N/A | 38886 | 38905 | AAAAGAATAAATACACCATG | 109 | 2424 |
| 1102926 | N/A | N/A | 38890 | 38909 | ACTTAAAAGAATAAATACAC | 83 | 2425 |
| 1102927 | N/A | N/A | 38913 | 38932 | GTGAAGTATATTTAAAAAAC | 74 | 2426 |
| 1102928 | N/A | N/A | 38927 | 38946 | TGAAACATTCAAAAGTGAAG | 87 | 2427 |
| 1102929 | N/A | N/A | 38933 | 38952 | GCTGTCTGAAACATTCAAAA | 79 | 2428 |
| 1100520* | 986 | 1005 | 38992 | 39011 | ACTCTGTCCTGATAGGTCCC | 17 | 2429 |
| 1100521* | 988 | 1007 | 38994 | 39013 | GAACTCTGTCCTGATAGGTC | 12 | 2430 |
| 1100522* | 1030 | 1049 | 39036 | 39055 | CCAAGTGCTCCTGAACTGGT | 19 | 2431 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100523* | 1040 | 1059 | 39046 | 39065 | TAGATCACTCCCAAGTGCTC | 17 | 2432 |
| 1100524* | 1043 | 1062 | 39049 | 39068 | ACCTAGATCACTCCCAAGTG | 16 | 2433 |
| 1100525* | 1044 | 1063 | N/A | N/A | CACCTAGATCACTCCCAAGT | 18 | 2434 |
| 1100526* | 1046 | 1065 | N/A | N/A | ATCACCTAGATCACTCCCAA | 20 | 2435 |
| 1100527* | 1047 | 1066 | N/A | N/A | CATCACCTAGATCACTCCCA | 12 | 2436 |
| 1100528* | 1049 | 1068 | N/A | N/A | AGCATCACCTAGATCACTCC | 10 | 2437 |
| 1100529* | 1050 | 1069 | N/A | N/A | TAGCATCACCTAGATCACTC | 24 | 2438 |
| 1100530* | 1052 | 1071 | N/A | N/A | CATAGCATCACCTAGATCAC | 21 | 2439 |
| 1100531* | 1082 | 1101 | 45608 | 45627 | CACAGCTGCCTGAAGCATGT | 70 | 2440 |
| 1100532* | 1083 | 1102 | 45609 | 45628 | TCACAGCTGCCTGAAGCATG | 19 | 2441 |
| 1100533* | 1084 | 1103 | 45610 | 45629 | GTCACAGCTGCCTGAAGCAT | 15 | 2442 |
| 1100534* | 1085 | 1104 | 45611 | 45630 | GGTCACAGCTGCCTGAAGCA | 4 | 2443 |
| 1100535* | 1086 | 1105 | 45612 | 45631 | TGGTCACAGCTGCCTGAAGC | 6 | 2444 |
| 1100536* | 1087 | 1106 | 45613 | 45632 | ATGGTCACAGCTGCCTGAAG | 13 | 2445 |
| 1100538* | 1089 | 1108 | 45615 | 45634 | ACATGGTCACAGCTGCCTGA | 20 | 2446 |
| 1100540* | 1091 | 1110 | 45617 | 45636 | AGACATGGTCACAGCTGCCT | 7 | 2447 |
| 1100541* | 1092 | 1111 | 45618 | 45637 | AAGACATGGTCACAGCTGCC | 11 | 2448 |
| 1100542* | 1093 | 1112 | 45619 | 45638 | AAAGACATGGTCACAGCTGC | 10 | 2449 |
| 1100543* | 1094 | 1113 | 45620 | 45639 | TAAAGACATGGTCACAGCTG | 19 | 2450 |
| 1100544* | 1095 | 1114 | 45621 | 45640 | CTAAAGACATGGTCACAGCT | 15 | 2451 |
| 1100545* | 1098 | 1117 | 45624 | 45643 | TTTCTAAAGACATGGTCACA | 50 | 2452 |
| 1100546* | 1099 | 1118 | 45625 | 45644 | GTTTCTAAAGACATGGTCAC | 19 | 2453 |
| 1100547* | 1102 | 1121 | 45628 | 45647 | ACAGTTTCTAAAGACATGGT | 35 | 2454 |
| 1100548* | 1103 | 1122 | 45629 | 45648 | GACAGTTTCTAAAGACATGG | 81 | 2455 |
| 1100549* | 1104 | 1123 | 45630 | 45649 | TGACAGTTTCTAAAGACATG | 47 | 2456 |
| 1100550* | 1105 | 1124 | 45631 | 45650 | CTGACAGTTTCTAAAGACAT | 34 | 2457 |
| 1100551* | 1106 | 1125 | 45632 | 45651 | TCTGACAGTTTCTAAAGACA | 36 | 2458 |
| 1100552* | 1111 | 1130 | 45637 | 45656 | TCATTTCTGACAGTTTCTAA | 24 | 2459 |
| 1100553* | 1114 | 1133 | 45640 | 45659 | AAATCATTTCTGACAGTTTC | 29 | 2460 |
| 1100554* | 1115 | 1134 | 45641 | 45660 | CAAATCATTTCTGACAGTTT | 27 | 2461 |
| 1100555* | 1118 | 1137 | 45644 | 45663 | TTTCAAATCATTTCTGACAG | 28 | 2462 |
| 1100556* | 1119 | 1138 | 45645 | 45664 | TTTTCAAATCATTTCTGACA | 53 | 2463 |
| 1102930* | N/A | N/A | 39053 | 39072 | CCTTACCTAGATCACTCCCA | 52 | 2464 |
| 1102931* | N/A | N/A | 39126 | 39145 | AAAGCAAAAATCACATGGAG | 58 | 2465 |
| 1102932* | N/A | N/A | 39144 | 39163 | GGGAATGAAGAATAATGTAA | 24 | 2466 |
| 1102933* | N/A | N/A | 39162 | 39181 | TCTTAATATGATTAAAGAGG | 61 | 2467 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102934* | N/A | N/A | 39163 | 39182 | TTCTTAATATGATTAAAGAG | 100 | 2468 |
| 1102935* | N/A | N/A | 39184 | 39203 | AGATTACAAATTTACTTAAG | 54 | 2469 |
| 1102936* | N/A | N/A | 39185 | 39204 | TAGATTACAAATTTACTTAA | 116 | 2470 |
| 1102937* | N/A | N/A | 39187 | 39206 | AGTAGATTACAAATTTACTT | 94 | 2471 |
| 1102938* | N/A | N/A | 39192 | 39211 | AATTTAGTAGATTACAAATT | 85 | 2472 |
| 1102939* | N/A | N/A | 39200 | 39219 | TCCAGGGAAATTTAGTAGAT | 16 | 2473 |
| 1102940* | N/A | N/A | 39207 | 39226 | TCCTTAATCCAGGGAAATTT | 75 | 2474 |
| 1102941* | N/A | N/A | 39213 | 39232 | AACTGCTCCTTAATCCAGGG | 22 | 2475 |
| 1102942* | N/A | N/A | 39215 | 39234 | GTAACTGCTCCTTAATCCAG | 36 | 2476 |
| 1102943* | N/A | N/A | 39307 | 39326 | TTCTAGCAATCCTCTCCTGC | 74 | 2477 |
| 1102944* | N/A | N/A | 39339 | 39358 | TTAAATTATTATGTTAAAGT | 100 | 2478 |
| 1102945* | N/A | N/A | 39340 | 39359 | TTTAAATTATTATGTTAAAG | 87 | 2479 |
| 1102946* | N/A | N/A | 39341 | 39360 | GTTTAAATTATTATGTTAAA | 96 | 2480 |
| 1102947* | N/A | N/A | 39342 | 39361 | AGTTTAAATTATTATGTTAA | 114 | 2481 |
| 1102948* | N/A | N/A | 39343 | 39362 | AAGTTTAAATTATTATGTTA | 92 | 2482 |
| 1102949* | N/A | N/A | 39344 | 39363 | GAAGTTTAAATTATTATGTT | 86 | 2483 |
| 1102951* | N/A | N/A | 39347 | 39366 | TGTGAAGTTTAAATTATTAT | 98 | 2484 |
| 1102953* | N/A | N/A | 39362 | 39381 | GACTGTACAAATTACTGTGA | 48 | 2485 |
| 1102954* | N/A | N/A | 39364 | 39383 | GAGACTGTACAAATTACTGT | 67 | 2486 |
| 1102955* | N/A | N/A | 39704 | 39723 | TACTAATATTCATGATTTCT | 66 | 2487 |
| 1102956* | N/A | N/A | 39705 | 39724 | CTACTAATATTCATGATTTC | 76 | 2488 |
| 1102957* | N/A | N/A | 39710 | 39729 | TTCACCTACTAATATTCATG | 35 | 2489 |
| 1102958* | N/A | N/A | 39711 | 39730 | TTTCACCTACTAATATTCAT | 82 | 2490 |
| 1102959* | N/A | N/A | 39713 | 39732 | TTTTTCACCTACTAATATTC | 82 | 2491 |
| 1102960* | N/A | N/A | 39714 | 39733 | ATTTTTCACCTACTAATATT | 104 | 2492 |
| 1102961* | N/A | N/A | 39753 | 39772 | CTCAAGTATTTTCATTTTC | 72 | 2493 |
| 1102962* | N/A | N/A | 39760 | 39779 | GATTATACTCAAGTATTTTT | 66 | 2494 |
| 1102963* | N/A | N/A | 39762 | 39781 | TAGATTATACTCAAGTATTT | 66 | 2495 |
| 1102964* | N/A | N/A | 39763 | 39782 | TTAGATTATACTCAAGTATT | 62 | 2496 |
| 1102965* | N/A | N/A | 39764 | 39783 | TTTAGATTATACTCAAGTAT | 72 | 2497 |
| 1102966* | N/A | N/A | 39767 | 39786 | TTATTTAGATTATACTCAAG | 79 | 2498 |
| 1102967* | N/A | N/A | 39769 | 39788 | TGTTATTTAGATTATACTCA | 56 | 2499 |
| 1102968* | N/A | N/A | 39774 | 39793 | CCCATTGTTATTTAGATTAT | 55 | 2500 |
| 1102969* | N/A | N/A | 39815 | 39834 | AGACATATTTAAACCGAGAC | 15 | 2501 |
| 1102970* | N/A | N/A | 39816 | 39835 | AAGACATATTTAAACCGAGA | 8 | 2502 |
| 1102971* | N/A | N/A | 39817 | 39836 | TAAGACATATTTAAACCGAG | 16 | 2503 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102972* | N/A | N/A | 39818 | 39837 | TTAAGACATATTTAAACCGA | 71 | 2504 |
| 1102973* | N/A | N/A | 39833 | 39852 | CTAATTGGCCAAAGTTTAAG | 57 | 2505 |
| 1102974* | N/A | N/A | 39844 | 39863 | AACTTCTACTACTAATTGGC | 37 | 2506 |
| 1102975* | N/A | N/A | 39850 | 39869 | TCTCTCAACTTCTACTACTA | 39 | 2507 |
| 1102976* | N/A | N/A | 39851 | 39870 | TTCTCTCAACTTCTACTACT | 60 | 2508 |
| 1102977* | N/A | N/A | 39860 | 39879 | AGTTACTTTTCTCTCAACT | 11 | 2509 |
| 1102978* | N/A | N/A | 39883 | 39902 | TGCTTATAATTTCTTTGTCA | 10 | 2510 |
| 1102979* | N/A | N/A | 39884 | 39903 | CTGCTTATAATTTCTTTGTC | 10 | 2511 |
| 1102980* | N/A | N/A | 39885 | 39904 | TCTGCTTATAATTTCTTTGT | 11 | 2512 |
| 1102981* | N/A | N/A | 39944 | 39963 | CCTTCACCTTTTTATTGAGT | 37 | 2513 |
| 1102982* | N/A | N/A | 39952 | 39971 | TTTCAAATCCTTCACCTTTT | 43 | 2514 |
| 1102983* | N/A | N/A | 39954 | 39973 | CTTTTCAAATCCTTCACCTT | 121 | 2515 |
| 1102984* | N/A | N/A | 39958 | 39977 | ATATCTTTTCAAATCCTTCA | 44 | 2516 |
| 1102985* | N/A | N/A | 40088 | 40107 | TTCATTAAAGCCATACCTAC | 88 | 2517 |
| 1102987* | N/A | N/A | 40171 | 40190 | TACACTTTTACATTCCCATT | 16 | 2518 |
| 1102989* | N/A | N/A | 40206 | 40225 | TTATCAAAAAATGCCAAAC | 103 | 2519 |
| 1102990* | N/A | N/A | 40207 | 40226 | TTTATCAAAAAATGCCAAA | 111 | 2520 |
| 1102991* | N/A | N/A | 40208 | 40227 | ATTTATCAAAAAATGCCAA | 71 | 2521 |
| 1102992* | N/A | N/A | 40210 | 40229 | ACATTTATCAAAAAATGCC | 84 | 2522 |
| 1102993* | N/A | N/A | 40211 | 40230 | TACATTTATCAAAAAATGC | 80 | 2523 |
| 1102994* | N/A | N/A | 40216 | 40235 | AAGTATACATTTATCAAAAA | 86 | 2524 |
| 1102995* | N/A | N/A | 40284 | 40303 | TATGTGAACCTAAGTTTTCT | 61 | 2525 |
| 1102996* | N/A | N/A | 40296 | 40315 | GATATAAGTTTTTATGTGAA | 34 | 2526 |
| 1102997* | N/A | N/A | 40957 | 40976 | AAGGTCTACATTTAGGCAGT | 75 | 2527 |
| 1102998* | N/A | N/A | 40979 | 40998 | TTGTGCATTCATTAACTAAA | 14 | 2528 |
| 1102999* | N/A | N/A | 41041 | 41060 | AGGAATAGAAAAAAGTACCA | 58 | 2529 |
| 1103000* | N/A | N/A | 41058 | 41077 | GGCTGTACTTAAACAGGAGG | 31 | 2530 |
| 1103001* | N/A | N/A | 41083 | 41102 | TTTTATACAAATGTTGAGGT | 14 | 2531 |
| 1103002* | N/A | N/A | 41085 | 41104 | TGTTTTATACAAATGTTGAG | 91 | 2532 |
| 1103003* | N/A | N/A | 41089 | 41108 | CTCATGTTTTATACAAATGT | 64 | 2533 |
| 1103004* | N/A | N/A | 41486 | 41505 | AAGAAAATCCAGTCCACTCC | 64 | 2534 |
| 1103005* | N/A | N/A | 41488 | 41507 | AAAAGAAAATCCAGTCCACT | 56 | 2535 |
| 1103006* | N/A | N/A | 41609 | 41628 | TCTAAAGGTTTTATCTTGC | 31 | 2536 |
| 1103007* | N/A | N/A | 41616 | 41635 | CTTATTATCTAAAGGTTTTT | 68 | 2537 |
| 1103008* | N/A | N/A | 41731 | 41750 | AGAAGTGTACCTTATGACTT | 50 | 2538 |
| 1103009* | N/A | N/A | 41812 | 41831 | AGTGTTATCACCTCCTGGAG | 106 | 2539 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103010* | N/A | N/A | 41814 | 41833 | GGAGTGTTATCACCTCCTGG | 63 | 2540 |
| 1103011* | N/A | N/A | 41881 | 41900 | CAGAGAGATGCCTATGTATT | 42 | 2541 |
| 1103012* | N/A | N/A | 42140 | 42159 | GGAGTGAAAGTCCAGGTTTC | 30 | 2542 |
| 1103013* | N/A | N/A | 42220 | 42239 | CATCTTCCAATTTAGCAAGC | 82 | 2543 |
| 1103014* | N/A | N/A | 42232 | 42251 | GAATCTTATTTACATCTTCC | 12 | 2544 |
| 1103015* | N/A | N/A | 42233 | 42252 | TGAATCTTATTTACATCTTC | 27 | 2545 |
| 1103016* | N/A | N/A | 42234 | 42253 | GTGAATCTTATTTACATCTT | 28 | 2546 |
| 1103017* | N/A | N/A | 42236 | 42255 | ATGTGAATCTTATTTACATC | 79 | 2547 |
| 1103018* | N/A | N/A | 42280 | 42299 | ATTTTCAATTAAATCCTGAA | 66 | 2548 |
| 1103019* | N/A | N/A | 42283 | 42302 | GTGATTTTCAATTAAATCCT | 70 | 2549 |
| 1103020* | N/A | N/A | 42579 | 42598 | CTGACACAAATTTAGATGGA | 64 | 2550 |
| 1103021* | N/A | N/A | 42764 | 42783 | CAGTGTTCAGAAATCTGACT | 87 | 2551 |
| 1103023* | N/A | N/A | 42864 | 42883 | CCTTCTGGCCTTTATGATCT | 69 | 2552 |
| 1103025* | N/A | N/A | 43501 | 43520 | GAGAAATTCCTTTAGCCATT | 16 | 2553 |
| 1103026* | N/A | N/A | 43502 | 43521 | AGAGAAATTCCTTTAGCCAT | 28 | 2554 |
| 1103027* | N/A | N/A | 43503 | 43522 | TAGAGAAATTCCTTTAGCCA | 19 | 2555 |
| 1103028* | N/A | N/A | 43504 | 43523 | TTAGAGAAATTCCTTTAGCC | 30 | 2556 |
| 1103029* | N/A | N/A | 43537 | 43556 | CCAAAATTACTTCTTTTATC | 46 | 2557 |
| 1103030* | N/A | N/A | 43539 | 43558 | TTCCAAAATTACTTCTTTTA | 67 | 2558 |
| 1103031* | N/A | N/A | 43540 | 43559 | GTTCCAAAATTACTTCTTTT | 15 | 2559 |
| 1103032* | N/A | N/A | 43541 | 43560 | TGTTCCAAAATTACTTCTTT | 43 | 2560 |
| 1103033* | N/A | N/A | 43542 | 43561 | ATGTTCCAAAATTACTTCTT | 95 | 2561 |
| 1103034* | N/A | N/A | 43545 | 43564 | CTGATGTTCCAAAATTACTT | 52 | 2562 |
| 1103035* | N/A | N/A | 43576 | 43595 | TTTTACTCTTTTTATTGTTC | 37 | 2563 |
| 1103036* | N/A | N/A | 43582 | 43601 | CCCATATTTTACTCTTTTTA | 30 | 2564 |
| 1103037* | N/A | N/A | 43584 | 43603 | TACCCATATTTTACTCTTTT | 50 | 2565 |
| 1103038* | N/A | N/A | 43620 | 43639 | TAGAAAATTCAAAAGGAGGG | 90 | 2566 |
| 1103039* | N/A | N/A | 43632 | 43651 | CATCATACAATTTAGAAAAT | 112 | 2567 |
| 1103040* | N/A | N/A | 43642 | 43661 | TTGCTTCAACCATCATACAA | 56 | 2568 |
| 1103041* | N/A | N/A | 43651 | 43670 | CTATAATTCTTGCTTCAACC | 19 | 2569 |
| 1103042* | N/A | N/A | 43670 | 43689 | ACTGAAAACCAAATCAGTGC | 91 | 2570 |
| 1103043* | N/A | N/A | 43672 | 43691 | ATACTGAAAACCAAATCAGT | 98 | 2571 |
| 1103044* | N/A | N/A | 43675 | 43694 | TATATACTGAAAACCAAATC | 156 | 2572 |
| 1103045* | N/A | N/A | 43693 | 43712 | CCTTAAATATTTCCAATATA | 73 | 2573 |
| 1103046* | N/A | N/A | 43699 | 43718 | ATAATGCCTTAAATATTTCC | 33 | 2574 |
| 1103047* | N/A | N/A | 43734 | 43753 | CCCTTTATATCCTTTGACCC | 46 | 2575 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103048* | N/A | N/A | 43741 | 43760 | GTTACCTCCCTTTATATCCT | 32 | 2576 |
| 1103049* | N/A | N/A | 43744 | 43763 | AAGGTTACCTCCCTTTATAT | 69 | 2577 |
| 1103050* | N/A | N/A | 43746 | 43765 | GAAAGGTTACCTCCCTTTAT | 82 | 2578 |
| 1103051* | N/A | N/A | 43747 | 43766 | AGAAAGGTTACCTCCCTTTA | 73 | 2579 |
| 1103052* | N/A | N/A | 43755 | 43774 | AGAAATATAGAAAGGTTACC | 93 | 2580 |
| 1103053* | N/A | N/A | 43768 | 43787 | GCATCAGTACAAAAGAAATA | 86 | 2581 |
| 1103054* | N/A | N/A | 43795 | 43814 | ATAGTGAAATTATTTTCCAA | 53 | 2582 |
| 1103055* | N/A | N/A | 43807 | 43826 | GTTTTAAACAAATAGTGAA | 95 | 2583 |
| 1103056* | N/A | N/A | 43811 | 43830 | TTCAGTTTTAAACAAATAG | 91 | 2584 |
| 1103057* | N/A | N/A | 43812 | 43831 | GTTCAGTTTTAAACAAATA | 48 | 2585 |
| 1103059* | N/A | N/A | 44052 | 44071 | TTCAGCAATTAAAGACTTTT | 48 | 2586 |
| 1103061* | N/A | N/A | 44073 | 44092 | CAAATATTAGCCAAAGAGGC | 90 | 2587 |
| 1103062* | N/A | N/A | 44396 | 44415 | ATAATGATCTTCCAGGCTGG | 138 | 2588 |
| 1103063* | N/A | N/A | 44400 | 44419 | CTAAATAATGATCTTCCAGG | 105 | 2589 |
| 1103064* | N/A | N/A | 44404 | 44423 | AGGACTAAATAATGATCTTC | 45 | 2590 |
| 1103065* | N/A | N/A | 44548 | 44567 | ATATAAATTTCTATTTTTGG | 81 | 2591 |
| 1103066* | N/A | N/A | 44549 | 44568 | AATATAAATTTCTATTTTTG | 112 | 2592 |
| 1103067* | N/A | N/A | 44674 | 44693 | CAGTAGAGTATTACATGCTA | 29 | 2593 |
| 1103068* | N/A | N/A | 44688 | 44707 | CTTTTTAATCCTGACAGTAG | 63 | 2594 |
| 1103069* | N/A | N/A | 44693 | 44712 | GGTTTCTTTTTAATCCTGAC | 89 | 2595 |
| 1103070* | N/A | N/A | 44695 | 44714 | TGGGTTTCTTTTTAATCCTG | 76 | 2596 |
| 1103071* | N/A | N/A | 44733 | 44752 | CCCCTGAGATCCAGCCACGG | 90 | 2597 |
| 1103072* | N/A | N/A | 44809 | 44828 | AGCTGTCATTTTTAGTTGAA | 31 | 2598 |
| 1103073* | N/A | N/A | 44826 | 44845 | GTTCTCTATCTCTATACAGC | 19 | 2599 |
| 1103074* | N/A | N/A | 44844 | 44863 | AGTGGAAACCACTAATATGT | 79 | 2600 |
| 1103075* | N/A | N/A | 44861 | 44880 | ACCCACTTTCTCTAACTAGT | 69 | 2601 |
| 1103076* | N/A | N/A | 44897 | 44916 | CTGCTATCGATTTATATTCC | 99 | 2602 |
| 1103077* | N/A | N/A | 44920 | 44939 | GTTATAATACCACAAAGATC | 26 | 2603 |
| 1103078* | N/A | N/A | 44921 | 44940 | TGTTATAATACCACAAAGAT | 80 | 2604 |
| 1103079* | N/A | N/A | 44923 | 44942 | AGTGTTATAATACCACAAAG | 52 | 2605 |
| 1103080* | N/A | N/A | 44924 | 44943 | AAGTGTTATAATACCACAAA | 76 | 2606 |
| 1103081* | N/A | N/A | 44925 | 44944 | GAAGTGTTATAATACCACAA | 33 | 2607 |
| 1103082* | N/A | N/A | 44932 | 44951 | AGACATAGAAGTGTTATAAT | 61 | 2608 |
| 1103083* | N/A | N/A | 44940 | 44959 | TACAATCAAGACATAGAAGT | 76 | 2609 |
| 1103084* | N/A | N/A | 44984 | 45003 | TACATGGCATTTTATCACAC | 32 | 2610 |
| 1103085* | N/A | N/A | 44997 | 45016 | TTATATGTAGTTCTACATGG | 62 | 2611 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103086* | N/A | N/A | 45032 | 45051 | CAAACTAAAACCTAGATATT | 90 | 2612 |
| 1103087* | N/A | N/A | 45035 | 45054 | GATCAAACTAAAACCTAGAT | 76 | 2613 |
| 1103088* | N/A | N/A | 45036 | 45055 | AGATCAAACTAAAACCTAGA | 91 | 2614 |
| 1103089* | N/A | N/A | 45038 | 45057 | AAAGATCAAACTAAAACCTA | 74 | 2615 |
| 1103090* | N/A | N/A | 45041 | 45060 | ACTAAAGATCAAACTAAAAC | 101 | 2616 |
| 1103091* | N/A | N/A | 45043 | 45062 | TAACTAAAGATCAAACTAAA | 113 | 2617 |
| 1103092* | N/A | N/A | 45044 | 45063 | GTAACTAAAGATCAAACTAA | 100 | 2618 |
| 1103093* | N/A | N/A | 45077 | 45096 | TTTGCCCAATTTCACCCAAT | 46 | 2619 |
| 1103095* | N/A | N/A | 45114 | 45133 | AGTTGTAAAGATATTTAAGA | 86 | 2620 |
| 1103097* | N/A | N/A | 45155 | 45174 | AAACCCAACTTTCTATTTTG | 57 | 2621 |
| 1103098* | N/A | N/A | 45161 | 45180 | TTACAAAAACCCAACTTTCT | 86 | 2622 |
| 1103099* | N/A | N/A | 45162 | 45181 | TTTACAAAAACCCAACTTTC | 79 | 2623 |
| 1103100* | N/A | N/A | 45165 | 45184 | GTATTTACAAAAACCCAACT | 45 | 2624 |
| 1103101* | N/A | N/A | 45167 | 45186 | ATGTATTTACAAAAACCCAA | 57 | 2625 |
| 1103102* | N/A | N/A | 45172 | 45191 | AATTCATGTATTTACAAAAA | 76 | 2626 |
| 1103103* | N/A | N/A | 45184 | 45203 | GTGTATATCAACAATTCATG | 8 | 2627 |
| 1103104* | N/A | N/A | 45186 | 45205 | TTGTGTATATCAACAATTCA | 65 | 2628 |
| 1103105* | N/A | N/A | 45313 | 45332 | GATAGCCACCAGTATATTCT | 75 | 2629 |
| 1103106* | N/A | N/A | 45316 | 45335 | CCAGATAGCCACCAGTATAT | 41 | 2630 |
| 1103107* | N/A | N/A | 45332 | 45351 | TCCCCATTTCCTAATCCCAG | 96 | 2631 |
| 1103108* | N/A | N/A | 45370 | 45389 | CCCCAGAAAATTCCCCCATG | 85 | 2632 |
| 1103109* | N/A | N/A | 45390 | 45409 | GATACACAACCATTCCATTG | 68 | 2633 |
| 1103110* | N/A | N/A | 45395 | 45414 | ATCAAGATACACAACCATTC | 63 | 2634 |
| 1103111* | N/A | N/A | 45410 | 45429 | TTTGACAAATACACCATCAA | 68 | 2635 |
| 1103112* | N/A | N/A | 45421 | 45440 | GTTCTATATATTTTGACAAA | 47 | 2636 |
| 1103113* | N/A | N/A | 45423 | 45442 | TAGTTCTATATATTTTGACA | 38 | 2637 |
| 1103114* | N/A | N/A | 45426 | 45445 | TTATAGTTCTATATATTTTG | 73 | 2638 |
| 1103115* | N/A | N/A | 45430 | 45449 | ACTTTTATAGTTCTATATAT | 104 | 2639 |
| 1103116* | N/A | N/A | 45473 | 45492 | CACGAGTTTCTTTTTTTGAT | 20 | 2640 |
| 1103117* | N/A | N/A | 45491 | 45510 | AATGTATTTCTATTTGAGCA | 40 | 2641 |
| 1103118* | N/A | N/A | 45520 | 45539 | CAAAGTCATCAAAAGGCAAG | 86 | 2642 |
| 1103119* | N/A | N/A | 45525 | 45544 | ATTCTCAAAGTCATCAAAAG | 84 | 2643 |
| 1103120* | N/A | N/A | 45529 | 45548 | GAAAATTCTCAAAGTCATCA | 99 | 2644 |
| 1103121* | N/A | N/A | 45534 | 45553 | TTCCAGAAAATTCTCAAAGT | 95 | 2645 |
| 1103122* | N/A | N/A | 45548 | 45567 | CATTTCTTTAAAATTTCCAG | 92 | 2646 |
| 1103123* | N/A | N/A | 45552 | 45571 | ACCACATTTCTTTAAAATTT | 88 | 2647 |

TABLE 2-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1103124* | N/A | N/A | 45559 | 45578 | AAACAAACCACATTTCTTT | 102 | 2648 |
| 1103125* | N/A | N/A | 45560 | 45579 | GAAACAAAACCACATTTCTT | 100 | 2649 |
| 1103126* | N/A | N/A | 45561 | 45580 | GGAAACAAAACCACATTTCT | 108 | 2650 |
| 1103127* | N/A | N/A | 45562 | 45581 | GGGAAACAAAACCACATTTC | 80 | 2651 |
| 1103128* | N/A | N/A | 45564 | 45583 | TTGGGAAACAAAACCACATT | 100 | 2652 |
| 1103129* | N/A | N/A | 45565 | 45584 | GTTGGGAAACAAAACCACAT | 94 | 2653 |

TABLE 3

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100368 | 312 | 331 | 16178 | 16197 | CCCAAACTTTCAAGGCATTG | 31 | 169 |
| 1100368 | 312 | 331 | 16178 | 16197 | CCCAAACTTTCAAGGCATTG | 30 | 169 |
| 1100404 | 407 | 426 | 16700 | 16719 | GTGTTCCTTATAATTGCATA | 32 | 203 |
| 1100404 | 407 | 426 | 16700 | 16719 | GTGTTCCTTATAATTGCATA | 31 | 203 |
| 1100440 | 515 | 534 | 21242 | 21261 | TAATTGAGCCAAGAAAAGTG | 96 | 237 |
| 1100440 | 515 | 534 | 21242 | 21261 | TAATTGAGCCAAGAAAAGTG | 130 | 237 |
| 1100476 | 711 | 730 | 27568 | 27587 | TTCCTGAGCCATCATTTGCT | 62 | 271 |
| 1100476 | 711 | 730 | 27568 | 27587 | TTCCTGAGCCATCATTTGCT | 71 | 271 |
| 1100512 | 886 | 905 | 28981 | 29000 | TCTGAAGTAAGATTTGTACC | 57 | 305 |
| 1100512 | 886 | 905 | 28981 | 29000 | TCTGAAGTAAGATTTGTACC | 95 | 305 |
| 1100548 | 1103 | 1122 | 45629 | 45648 | GACAGTTTCTAAAGACATGG | 62 | 2455 |
| 1100584 | 1244 | 1263 | 45770 | 45789 | AAGTCTTATTTCCTCATCTC | 18 | 338 |
| 1100584 | 1244 | 1263 | 45770 | 45789 | AAGTCTTATTTCCTCATCTC | 16 | 338 |
| 1100620 | 1619 | 1638 | 46145 | 46164 | GAACCATTACTATTATCAAC | 31 | 372 |
| 1100620 | 1619 | 1638 | 46145 | 46164 | GAACCATTACTATTATCAAC | 35 | 372 |
| 1100656 | 1807 | 1826 | 46333 | 46352 | AGTCATGAAATAATGATCCC | 76 | 406 |
| 1100656 | 1807 | 1826 | 46333 | 46352 | AGTCATGAAATAATGATCCC | 59 | 406 |
| 1100692 | 2047 | 2066 | 46573 | 46592 | TAGTCTTCTAACAGAAGGAG | 81 | 440 |
| 1100728 | 2236 | 2255 | 46762 | 46781 | TCATGTTCCAGATCACCATC | 38 | 474 |
| 1100728 | 2236 | 2255 | 46762 | 46781 | TCATGTTCCAGATCACCATC | 34 | 474 |
| 1100764 | 2386 | 2405 | 46912 | 46931 | AATTAAAGAGAATATTTATC | 95 | 508 |
| 1100764 | 2386 | 2405 | 46912 | 46931 | AATTAAAGAGAATATTTATC | 96 | 508 |
| 1100800 | 2570 | 2589 | 47096 | 47115 | GAAGTTGTCAGCTGAAATTT | 35 | 542 |
| 1100800 | 2570 | 2589 | 47096 | 47115 | GAAGTTGTCAGCTGAAATTT | 38 | 542 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1100836 | 2744 | 2763 | 47270 | 47289 | AATGACTTAAAAAATCTGTT | 84 | 576 |
| 1100836 | 2744 | 2763 | 47270 | 47289 | AATGACTTAAAAAATCTGTT | 85 | 576 |
| 1100872 | 2927 | 2946 | 47453 | 47472 | CAGTCTTAAAATATTTAGCT | 19 | 610 |
| 1100872 | 2927 | 2946 | 47453 | 47472 | CAGTCTTAAAATATTTAGCT | 14 | 610 |
| 1100908 | 3062 | 3081 | 47588 | 47607 | TCTCATTTTTATATTAGGTA | 31 | 644 |
| 1100908 | 3062 | 3081 | 47588 | 47607 | TCTCATTTTTATATTAGGTA | 20 | 644 |
| 1100914 | 3074 | 3093 | 47600 | 47619 | GCATATTGGTTTTCTCATTT | 8 | 45 |
| 1100914 | 3074 | 3093 | 47600 | 47619 | GCATATTGGTTTTCTCATTT | 9 | 45 |
| 1100945 | 3555 | 3574 | 48081 | 48100 | TCACAACAAACTACACAAAC | 77 | 678 |
| 1100945 | 3555 | 3574 | 48081 | 48100 | TCACAACAAACTACACAAAC | 70 | 678 |
| 1100981 | 3682 | 3701 | 48208 | 48227 | CTGGCATCTTTTCATACTGG | 37 | 712 |
| 1100981 | 3682 | 3701 | 48208 | 48227 | CTGGCATCTTTTCATACTGG | 33 | 712 |
| 1101017 | 3874 | 3893 | 48400 | 48419 | TATTAAACATTAAGATGTTC | 78 | 746 |
| 1101017 | 3874 | 3893 | 48400 | 48419 | TATTAAACATTAAGATGTTC | 88 | 746 |
| 1101053 | 3935 | 3954 | 48461 | 48480 | GTACATACTTGATCCCAGTA | 20 | 780 |
| 1101053 | 3935 | 3954 | 48461 | 48480 | GTACATACTTGATCCCAGTA | 16 | 780 |
| 1101089 | 4022 | 4041 | 48548 | 48567 | AAAACATAAATTACTCATTA | 102 | 814 |
| 1101089 | 4022 | 4041 | 48548 | 48567 | AAAACATAAATTACTCATTA | 100 | 814 |
| 1101125 | 4170 | 4189 | 48696 | 48715 | AATTGTAAATTATTTGGCCA | 78 | 848 |
| 1101125 | 4170 | 4189 | 48696 | 48715 | AATTGTAAATTATTTGGCCA | 62 | 848 |
| 1101161 | 4834 | 4853 | 49360 | 49379 | CTACTTAAGATTTTAAAATT | 96 | 882 |
| 1101161 | 4834 | 4853 | 49360 | 49379 | CTACTTAAGATTTTAAAATT | 137 | 882 |
| 1101197 | 5992 | 6011 | 50518 | 50537 | TAATTAGGGTCACATATATA | 70 | 916 |
| 1101197 | 5992 | 6011 | 50518 | 50537 | TAATTAGGGTCACATATATA | 113 | 916 |
| 1101233 | 6228 | 6247 | 50754 | 50773 | ATCAAAATTCTAGAATTTAC | 92 | 950 |
| 1101233 | 6228 | 6247 | 50754 | 50773 | ATCAAAATTCTAGAATTTAC | 72 | 950 |
| 1101269 | 6563 | 6582 | 51089 | 51108 | CAGTGTTGTAAAAATTAGAT | 81 | 984 |
| 1101269 | 6563 | 6582 | 51089 | 51108 | CAGTGTTGTAAAAATTAGAT | 78 | 984 |
| 1101305 | 6764 | 6783 | 51290 | 51309 | GTGTGTGTAATAACAGCAAA | 75 | 1018 |
| 1101305 | 6764 | 6783 | 51290 | 51309 | GTGTGTGTAATAACAGCAAA | 89 | 1018 |
| 1101341 | 96 | 115 | 13165 | 13184 | GAGCACAAAGTGAGCCTTCT | 60 | 1052 |
| 1101341 | 96 | 115 | 13165 | 13184 | GAGCACAAAGTGAGCCTTCT | 91 | 1052 |
| 1101377 | 229 | 248 | 13298 | 13317 | GTGCGATAATCTTCACTAGT | 82 | 1086 |
| 1101377 | 229 | 248 | 13298 | 13317 | GTGCGATAATCTTCACTAGT | 85 | 1086 |
| 1101413 | N/A | N/A | 51449 | 51468 | ACACAAATTCAAAAGGAAAT | 91 | 1116 |
| 1101413 | N/A | N/A | 51449 | 51468 | ACACAAATTCAAAAGGAAAT | 85 | 1116 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1101593 | N/A | N/A | 4174 | 4193 | CACTCCTAATACCTAAAAAC | 97 | 1166 |
| 1101593 | N/A | N/A | 4174 | 4193 | CACTCCTAATACCTAAAAAC | 119 | 1166 |
| 1101629 | N/A | N/A | 5365 | 5384 | GCCTTTGAAAATTAATAACA | 89 | 1200 |
| 1101629 | N/A | N/A | 5365 | 5384 | GCCTTTGAAAATTAATAACA | 86 | 1200 |
| 1101665 | N/A | N/A | 6667 | 6686 | TGACAGAGACTACAGCTGGC | 91 | 1234 |
| 1101665 | N/A | N/A | 6667 | 6686 | TGACAGAGACTACAGCTGGC | 76 | 1234 |
| 1101701 | N/A | N/A | 7486 | 7505 | ACACTACTAACTACAACACA | 87 | 1268 |
| 1101701 | N/A | N/A | 7486 | 7505 | ACACTACTAACTACAACACA | 117 | 1268 |
| 1101737 | N/A | N/A | 8823 | 8842 | TCAGTACAAATTTAAAAATC | 84 | 1302 |
| 1101737 | N/A | N/A | 8823 | 8842 | TCAGTACAAATTTAAAAATC | 102 | 1302 |
| 1101773 | N/A | N/A | 9341 | 9360 | TTCCAGTCACAAAAGCTCAA | 59 | 1336 |
| 1101773 | N/A | N/A | 9341 | 9360 | TTCCAGTCACAAAAGCTCAA | 57 | 1336 |
| 1101809 | N/A | N/A | 10463 | 10482 | TACTGAATAATATGCAAATT | 107 | 1370 |
| 1101809 | N/A | N/A | 10463 | 10482 | TACTGAATAATATGCAAATT | 98 | 1370 |
| 1101845 | N/A | N/A | 11711 | 11730 | CCCTAGAACATTTATTCTTT | 84 | 1404 |
| 1101845 | N/A | N/A | 11711 | 11730 | CCCTAGAACATTTATTCTTT | 86 | 1404 |
| 1101881 | N/A | N/A | 13129 | 13148 | AGAAAAAATTAAAATGTGAC | 80 | 1438 |
| 1101881 | N/A | N/A | 13129 | 13148 | AGAAAAAATTAAAATGTGAC | 105 | 1438 |
| 1101917 | N/A | N/A | 14390 | 14409 | AAGGAATTTTTAAATGCCCC | 70 | 1472 |
| 1101917 | N/A | N/A | 14390 | 14409 | AAGGAATTTTTAAATGCCCC | 72 | 1472 |
| 1101953 | N/A | N/A | 15441 | 15460 | CTGGGCATTTAAACTGAAGG | 59 | 1506 |
| 1101953 | N/A | N/A | 15441 | 15460 | CTGGGCATTTAAACTGAAGG | 46 | 1506 |
| 1101989 | N/A | N/A | 16110 | 16129 | CCATTCCAAATTTAGGAAGT | 92 | 1540 |
| 1101989 | N/A | N/A | 16110 | 16129 | CCATTCCAAATTTAGGAAGT | 73 | 1540 |
| 1102025 | N/A | N/A | 17173 | 17192 | TTCCTAATTTTAAAGTCAGC | 33 | 1574 |
| 1102025 | N/A | N/A | 17173 | 17192 | TTCCTAATTTTAAAGTCAGC | 43 | 1574 |
| 1102061 | N/A | N/A | 17584 | 17603 | CTTGCTCAAGACATATTTCA | 60 | 1608 |
| 1102061 | N/A | N/A | 17584 | 17603 | CTTGCTCAAGACATATTTCA | 52 | 1608 |
| 1102097 | N/A | N/A | 19126 | 19145 | CCAGAGGTTAAATAATCTCA | 56 | 1642 |
| 1102097 | N/A | N/A | 19126 | 19145 | CCAGAGGTTAAATAATCTCA | 47 | 1642 |
| 1102133 | N/A | N/A | 19460 | 19479 | ACAATGTTAATACTTTTTCC | 50 | 1676 |
| 1102133 | N/A | N/A | 19460 | 19479 | ACAATGTTAATACTTTTTCC | 63 | 1676 |
| 1102169 | N/A | N/A | 20122 | 20141 | TGTCAAAAGATTCCAATTGT | 65 | 1710 |
| 1102169 | N/A | N/A | 20122 | 20141 | TGTCAAAAGATTCCAATTGT | 62 | 1710 |
| 1102205 | N/A | N/A | 21101 | 21120 | TTAAGAATAGATACAACCCA | 80 | 1744 |
| 1102205 | N/A | N/A | 21101 | 21120 | TTAAGAATAGATACAACCCA | 89 | 1744 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102241 | N/A | N/A | 22464 | 22483 | TTTATGTTATTTTTAGCCA | 86 | 1778 |
| 1102241 | N/A | N/A | 22464 | 22483 | TTTATGTTATTTTTAGCCA | 77 | 1778 |
| 1102277 | N/A | N/A | 23289 | 23308 | AGAGACAATCCTAAGGAAAA | 83 | 1812 |
| 1102277 | N/A | N/A | 23289 | 23308 | AGAGACAATCCTAAGGAAAA | 90 | 1812 |
| 1102313 | N/A | N/A | 24093 | 24112 | TTAGGAAAACCACAGCATGG | 84 | 1846 |
| 1102313 | N/A | N/A | 24093 | 24112 | TTAGGAAAACCACAGCATGG | 78 | 1846 |
| 1102349 | N/A | N/A | 25507 | 25526 | CCAGAAATCCAGGGTTTCCC | 62 | 1880 |
| 1102349 | N/A | N/A | 25507 | 25526 | CCAGAAATCCAGGGTTTCCC | 92 | 1880 |
| 1102385 | N/A | N/A | 26322 | 26341 | TCTTGGTTTCTACTGTTAAA | 21 | 1914 |
| 1102385 | N/A | N/A | 26322 | 26341 | TCTTGGTTTCTACTGTTAAA | 22 | 1914 |
| 1102421 | N/A | N/A | 27036 | 27055 | TAATATATTTAAGTATTTCA | 77 | 1948 |
| 1102421 | N/A | N/A | 27036 | 27055 | TAATATATTTAAGTATTTCA | 115 | 1948 |
| 1102457 | N/A | N/A | 27887 | 27906 | AAAAATATAACTACTCCTAA | 83 | 1982 |
| 1102457 | N/A | N/A | 27887 | 27906 | AAAAATATAACTACTCCTAA | 59 | 1982 |
| 1102493 | N/A | N/A | 28293 | 28312 | AAATAATTTCATTAGAAAGT | 89 | 2016 |
| 1102493 | N/A | N/A | 28293 | 28312 | AAATAATTTCATTAGAAAGT | 80 | 2016 |
| 1102529 | N/A | N/A | 29028 | 29047 | AACTACTTTACTTTTCAAAG | 81 | 2050 |
| 1102529 | N/A | N/A | 29028 | 29047 | AACTACTTTACTTTTCAAAG | 104 | 2050 |
| 1102565 | N/A | N/A | 30354 | 30373 | AGAATGGATGAAATACAGCA | 53 | 2084 |
| 1102565 | N/A | N/A | 30354 | 30373 | AGAATGGATGAAATACAGCA | 81 | 2084 |
| 1102601 | N/A | N/A | 30610 | 30629 | TTAGCCATTAATCTATACTG | 34 | 2118 |
| 1102601 | N/A | N/A | 30610 | 30629 | TTAGCCATTAATCTATACTG | 32 | 2118 |
| 1102637 | N/A | N/A | 32676 | 32695 | GCCAAAATACTAACATCAGT | 25 | 2152 |
| 1102637 | N/A | N/A | 32676 | 32695 | GCCAAAATACTAACATCAGT | 33 | 2152 |
| 1102673 | N/A | N/A | 33921 | 33940 | TGTTTACTAAAAAGCACTAG | 65 | 2186 |
| 1102673 | N/A | N/A | 33921 | 33940 | TGTTTACTAAAAAGCACTAG | 98 | 2186 |
| 1102709 | N/A | N/A | 34405 | 34424 | CTTCAAATACTCAAAAGGG | 63 | 2220 |
| 1102709 | N/A | N/A | 34405 | 34424 | CTTCAAATACTCAAAAGGG | 63 | 2220 |
| 1102745 | N/A | N/A | 34877 | 34896 | GGCTTGAAAATATTATTTAA | 83 | 2254 |
| 1102745 | N/A | N/A | 34877 | 34896 | GGCTTGAAAATATTATTTAA | 89 | 2254 |
| 1102781 | N/A | N/A | 35566 | 35585 | TGCCAGTCCCAAAATTCTGC | 83 | 2288 |
| 1102781 | N/A | N/A | 35566 | 35585 | TGCCAGTCCCAAAATTCTGC | 95 | 2288 |
| 1102817 | N/A | N/A | 37177 | 37196 | TACCAGCAACAATTATTAAT | 67 | 2322 |
| 1102817 | N/A | N/A | 37177 | 37196 | TACCAGCAACAATTATTAAT | 68 | 2322 |
| 1102853 | N/A | N/A | 37900 | 37919 | ATCAGATTTTAAGTAATACT | 66 | 2356 |
| 1102853 | N/A | N/A | 37900 | 37919 | ATCAGATTTTAAGTAATACT | 94 | 2356 |

TABLE 3-continued

Percent control of human ATXN3 RNA with 5-10-5 MOE gapmers with mixed internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | ATXN3 (% control) | SEQ ID NO |
|---|---|---|---|---|---|---|---|
| 1102889 | N/A | N/A | 38368 | 38387 | AAAACCTATCATACAAAAAG | 95 | 2390 |
| 1102889 | N/A | N/A | 38368 | 38387 | AAAACCTATCATACAAAAAG | 108 | 2390 |
| 1102925 | N/A | N/A | 38886 | 38905 | AAAAGAATAAATACACCATG | 84 | 2424 |
| 1102925 | N/A | N/A | 38886 | 38905 | AAAAGAATAAATACACCATG | 102 | 2424 |
| 1102961 | N/A | N/A | 39753 | 39772 | CTCAAGTATTTTTCATTTTC | 45 | 2493 |
| 1102997 | N/A | N/A | 40957 | 40976 | AAGGTCTACATTTAGGCAGT | 38 | 2527 |
| 1103033 | N/A | N/A | 43542 | 43561 | ATGTTCCAAAATTACTTCTT | 52 | 2561 |
| 1103069 | N/A | N/A | 44693 | 44712 | GGTTTCTTTTTAATCCTGAC | 13 | 2595 |
| 1103105 | N/A | N/A | 45313 | 45332 | GATAGCCACCAGTATATTCT | 32 | 2629 |
| 1100548* | 1103 | 1122 | 45629 | 45648 | GACAGTTTCTAAAGACATGG | 47 | 2455 |
| 1100692* | 2047 | 2066 | 46573 | 46592 | TAGTCTTCTAACAGAAGGAG | 58 | 440 |
| 1102961* | N/A | N/A | 39753 | 39772 | CTCAAGTATTTTTCATTTTC | 46 | 2493 |
| 1102997* | N/A | N/A | 40957 | 40976 | AAGGTCTACATTTAGGCAGT | 34 | 2527 |
| 1103033* | N/A | N/A | 43542 | 43561 | ATGTTCCAAAATTACTTCTT | 50 | 2561 |
| 1103069* | N/A | N/A | 44693 | 44712 | GGTTTCTTTTTAATCCTGAC | 14 | 2595 |
| 1103105* | N/A | N/A | 45313 | 45332 | GATAGCCACCAGTATATTCT | 35 | 2629 |

TABLE 4

Percent control of human ATXN3 RNA with 5-10-5 MOE gapmers with mixed internucleoside linkages

| Compound Number | SEQ ID No: 3 Start Site | SEQ ID No: 3 Stop Site | Sequence (5' to 3') | ATXN3 (% control) | SEQ ID NO |
|---|---|---|---|---|---|
| 1100366 | 88 | 107 | GCATTGCTTATAACTTTCTC | 63 | 2654 |
| 1100367 | 89 | 108 | GGCATTGCTTATAACTTTCT | 49 | 2655 |

TABLE 5

Percent control of human ATXN3 RNA with 5-10-5 MOE gapmers with mixed internucleoside linkages

| Compound Number | SEQ ID No: 4 Start Site | SEQ ID No: 4 Stop Site | Sequence (5' to 3') | ATXN3 (% control) | SEQ ID NO |
|---|---|---|---|---|---|
| 1101399 | 291 | 310 | TAAACCACTGAATAGAGAAA | 91 | 2656 |
| 1101400 | 294 | 313 | AGTTAAACCACTGAATAGAG | 76 | 2657 |
| 1101401 | 295 | 314 | AAGTTAAACCACTGAATAGA | 107 | 2658 |
| 1101402 | 297 | 316 | TCAAGTTAAACCACTGAATA | 65 | 2659 |
| 1101403 | 298 | 317 | TTCAAGTTAAACCACTGAAT | 90 | 2660 |
| 1101404 | 300 | 319 | AATTCAAGTTAAACCACTGA | 89 | 2661 |

TABLE 6

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% control) | SEQ ID NO |
|---|---|---|---|---|---|
| 1101448 | 9782 | 9801 | CAAAGCAGTTAAATCTGGCC | 96 | 2662 |
| 1101449 | 10192 | 10211 | TGGGTTTATATATTTTTCTT | 72 | 2663 |

TABLE 6-continued

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% control) | SEQ ID NO |
|---|---|---|---|---|---|
| 1101449 | 10192 | 10211 | TGGGTTTATATATTTTTCTT | 100 | 2663 |
| 1101449 | 10192 | 10211 | TGGGTTTATATATTTTTCTT | 111 | 2663 |
| 1101450 | 10194 | 10213 | TGTGGGTTTATATATTTTTC | 78 | 2664 |
| 1101451 | 10235 | 10254 | TAATCCAATGAATGCATCTC | 79 | 2665 |
| 1101452 | 10588 | 10607 | AAGTCACTGTTATATTAGTT | 201 | 2666 |
| 1101453 | 10595 | 10614 | GCATGTAAAGTCACTGTTAT | 121 | 2667 |
| 1101454 | 10609 | 10628 | AAAAAAAACCCATAGCATGT | 109 | 2668 |
| 1101455 | 10610 | 10629 | GAAAAAAAACCCATAGCATG | 89 | 2669 |
| 1101456 | 10611 | 10630 | AGAAAAAAAACCCATAGCAT | 81 | 2670 |
| 1101457 | 10615 | 10634 | GAGGAGAAAAAAAACCCATA | 95 | 2671 |
| 1101458 | 10630 | 10649 | ATTTCTTGAAGATGAGAGGA | 99 | 2672 |
| 1101459 | 10683 | 10702 | AGCAGATTCCTGACACTGTG | 110 | 2673 |
| 1101460 | 10684 | 10703 | GAGCAGATTCCTGACACTGT | 118 | 2674 |
| 1101461 | 10697 | 10716 | AATTATACAGAAAGAGCAGA | 84 | 2675 |
| 1101462 | 10699 | 10718 | ACAATTATACAGAAAGAGCA | 127 | 2676 |
| 1101463 | 10701 | 10720 | TAACAATTATACAGAAAGAG | 95 | 2677 |
| 1101464 | 10702 | 10721 | GTAACAATTATACAGAAAGA | 99 | 2678 |
| 1101465 | 10703 | 10722 | TGTAACAATTATACAGAAAG | 109 | 2679 |
| 1101466 | 10704 | 10723 | CTGTAACAATTATACAGAAA | 124 | 2680 |
| 1101467 | 10705 | 10724 | CCTGTAACAATTATACAGAA | 71 | 2681 |
| 1101468 | 10706 | 10725 | TCCTGTAACAATTATACAGA | 90 | 2682 |
| 1101469 | 11124 | 11143 | AGGATGAGATACAAGGTCAA | 108 | 2683 |
| 1101470 | 11556 | 11575 | ACATAAAGCCATTATGTCAG | 91 | 2684 |
| 1101471 | 11557 | 11576 | TACATAAAGCCATTATGTCA | 96 | 2685 |
| 1101472 | 11558 | 11577 | GTACATAAAGCCATTATGTC | 74 | 2686 |
| 1101473 | 11564 | 11583 | AGCCATGTACATAAAGCCAT | 105 | 2687 |
| 1101474 | 12097 | 12116 | AAAAACCACCTTGTAGCTAG | 107 | 2688 |
| 1101475 | 12100 | 12119 | AATAAAAACCACCTTGTAGC | 86 | 2689 |
| 1101476 | 12101 | 12120 | GAATAAAAACCACCTTGTAG | 79 | 2690 |
| 1101477 | 12102 | 12121 | AGAATAAAAACCACCTTGTA | 77 | 2691 |
| 1101478 | 12103 | 12122 | CAGAATAAAAACCACCTTGT | 77 | 2692 |
| 1101479 | 12105 | 12124 | CCCAGAATAAAAACCACCTT | 72 | 2693 |
| 1101480 | 12106 | 12125 | ACCCAGAATAAAAACCACCT | 89 | 2694 |
| 1101481 | 12113 | 12132 | CATGGCAACCCAGAATAAAA | 88 | 2695 |
| 1101482 | 12114 | 12133 | GCATGGCAACCCAGAATAAA | 94 | 2696 |
| 1101483 | 12502 | 12521 | CTGGAACACTTTTAAAAAAT | 87 | 2697 |
| 1101484 | 12535 | 12554 | TTTCTTACTCCCCTATGCCC | 95 | 2698 |
| 1101485 | 12541 | 12560 | TTCCACTTTCTTACTCCCCT | 87 | 2699 |
| 1101485 | 12541 | 12560 | TTCCACTTTCTTACTCCCCT | 110 | 2699 |
| 1101485 | 12541 | 12560 | TTCCACTTTCTTACTCCCCT | 93 | 2699 |
| 1101486 | 12542 | 12561 | TTTCCACTTTCTTACTCCCC | 79 | 2700 |
| 1101487 | 12626 | 12645 | ATGTGAATATCCTGCCTCCA | 111 | 2701 |
| 1101488 | 12688 | 12707 | ACCTTATTCAGCCAGAGTTG | 92 | 2702 |
| 1101489 | 12691 | 12710 | GCAACCTTATTCAGCCAGAG | 79 | 2703 |
| 1101490 | 12725 | 12744 | GCCCATACTTTCCAGGTGCC | 77 | 2704 |
| 1101491 | 12727 | 12746 | GAGCCCATACTTTCCAGGTG | 102 | 2705 |
| 1101492 | 12732 | 12751 | TACTGGAGCCCATACTTTCC | 98 | 2706 |
| 1101493 | 12785 | 12804 | CCCTTTACCACTTTTGTGCA | 70 | 2707 |
| 1101494 | 12788 | 12807 | CATCCCTTTACCACTTTTGT | 81 | 2708 |
| 1101495 | 12827 | 12846 | CATGACAGCCAAGATGCCAG | 87 | 2709 |
| 1101496 | 12938 | 12957 | TTAGCATTTCTCTTCTGTTG | 78 | 2710 |
| 1101497 | 13356 | 13375 | TGTTGCTTTCCTTTCCTGCA | 97 | 2711 |
| 1101498 | 13395 | 13414 | GATTTCAGTCTACATCTAAC | 111 | 2712 |
| 1101499 | 13399 | 13418 | TCCTGATTTCAGTCTACATC | 88 | 2713 |
| 1101500 | 13402 | 13421 | ACCTCCTGATTTCAGTCTAC | 96 | 2714 |
| 1101501 | 13414 | 13433 | AGTTTTAACCACACCTCCTG | 91 | 2715 |
| 1101502 | 13418 | 13437 | AAAGAGTTTTAACCACACCT | 92 | 2716 |
| 1101503 | 13428 | 13447 | AGCCTCTTTCAAAGAGTTTT | 90 | 2717 |
| 1101504 | 13917 | 13936 | TCTGAAATTAATAATGGTGT | 117 | 2718 |
| 1101505 | 13919 | 13938 | GCTCTGAAATTAATAATGGT | 89 | 2719 |
| 1101506 | 13968 | 13987 | GCCTTGTTTTCTTCCAAGAA | 119 | 2720 |
| 1101507 | 14062 | 14081 | ACAAAACATCAAGAATTCTA | 92 | 2721 |
| 1101508 | 14064 | 14083 | CAACAAAACATCAAGAATTC | 101 | 2722 |
| 1101509 | 14065 | 14084 | TCAACAAAACATCAAGAATT | 125 | 2723 |
| 1101510 | 14066 | 14085 | TTCAACAAAACATCAAGAAT | 86 | 2724 |
| 1101511 | 14069 | 14088 | GTTTTCAACAAAACATCAAG | 143 | 2725 |
| 1101512 | 14070 | 14089 | TGTTTTCAACAAAACATCAA | 86 | 2726 |
| 1101513 | 14074 | 14093 | CTTCTGTTTTCAACAAAACA | 94 | 2727 |
| 1101514 | 14076 | 14095 | TGCTTCTGTTTTCAACAAAA | 90 | 2728 |
| 1101515 | 14111 | 14130 | GAATCTTTCTAAAACTTACC | 62 | 2729 |

TABLE 6-continued

Percent control of human ATXN3 RNA with 5-10-5 MOE gapmers with mixed internucleoside linkages

| Compound Number | SEQ ID No: 5 Start Site | SEQ ID No: 5 Stop Site | Sequence (5' to 3') | ATXN3 (% control) | SEQ ID NO |
|---|---|---|---|---|---|
| 1101516 | 14112 | 14131 | AGAATCTTTCTAAAACTTAC | 81 | 2730 |
| 1101517 | 14115 | 14134 | TACAGAATCTTTCTAAAACT | 80 | 2731 |
| 1101518 | 14207 | 14226 | GTACCAAGATTATATTGCCT | 90 | 2732 |
| 1101519 | 14208 | 14227 | TGTACCAAGATTATATTGCC | 84 | 2733 |
| 1101520 | 14209 | 14228 | TTGTACCAAGATTATATTGC | 102 | 2734 |
| 1101521 | 14212 | 14231 | ATGTTGTACCAAGATTATAT | 116 | 2735 |
| 1101521 | 14212 | 14231 | ATGTTGTACCAAGATTATAT | 70 | 2735 |
| 1101521 | 14212 | 14231 | ATGTTGTACCAAGATTATAT | 130 | 2735 |
| 1101522 | 14214 | 14233 | AAATGTTGTACCAAGATTAT | 76 | 2736 |
| 1101523 | 14239 | 14258 | AAGTCTTATTCATTGCAGCT | 80 | 2737 |
| 1101524 | 14240 | 14259 | TAAGTCTTATTCATTGCAGC | 95 | 2738 |
| 1101525 | 14430 | 14449 | TCTGAATTTCTAAGCATTAG | 99 | 2739 |
| 1101526 | 14431 | 14450 | TTCTGAATTTCTAAGCATTA | 95 | 2740 |
| 1101527 | 14432 | 14451 | TTTCTGAATTTCTAAGCATT | 98 | 2741 |
| 1101528 | 14456 | 14475 | GACTTTAAAATTTAGTCTGA | 83 | 2742 |
| 1101529 | 14459 | 14478 | GTAGACTTTAAAATTTAGTC | 78 | 2743 |
| 1101530 | 14460 | 14479 | AGTAGACTTTAAAATTTAGT | 92 | 2744 |
| 1101531 | 14461 | 14480 | AAGTAGACTTTAAAATTTAG | 81 | 2745 |
| 1101532 | 14507 | 14526 | TCAAAATGAATTTATTTATG | 91 | 2746 |
| 1101533 | 14509 | 14528 | CATCAAAATGAATTTATTTA | 87 | 2747 |
| 1101534 | 14515 | 14534 | GAAAACCATCAAAATGAATT | 120 | 2748 |
| 1101535 | 14518 | 14537 | TGAGAAAACCATCAAAATGA | 63 | 2749 |
| 1101536 | 14519 | 14538 | CTGAGAAAACCATCAAAATG | 102 | 2750 |
| 1101537 | 14520 | 14539 | TCTGAGAAAACCATCAAAAT | 114 | 2751 |
| 1101538 | 14523 | 14542 | TGTTCTGAGAAAACCATCAA | 150 | 2752 |
| 1101539 | 14850 | 14869 | TTTCCATTACTCAAGCAGTG | 74 | 2753 |
| 1101540 | 15114 | 15133 | AAAGACATACAAGTTTGATA | 127 | 2754 |
| 1101541 | 15119 | 15138 | AGTTAAAAGACATACAAGTT | 83 | 2755 |
| 1101542 | 15120 | 15139 | AAGTTAAAAGACATACAAGT | 104 | 2756 |
| 1101543 | 15189 | 15208 | TGGTGGGTACATAAGGTTCA | 105 | 2757 |
| 1101544 | 15215 | 15234 | AGGAACTGATAATTGTTGAA | 86 | 2758 |
| 1101545 | 15232 | 15251 | GTGAAACAAGAATTGTCAGG | 91 | 2759 |
| 1101546 | 15333 | 15352 | GCTTCAAAATAATGGAAGTT | 107 | 2760 |
| 1101547 | 15334 | 15353 | TGCTTCAAAATAATGGAAGT | 107 | 2761 |
| 1101548 | 15335 | 15354 | GTGCTTCAAAATAATGGAAG | 106 | 2762 |
| 1101549 | 15336 | 15355 | TGTGCTTCAAAATAATGGAA | 90 | 2763 |
| 1101550 | 15337 | 15356 | ATGTGCTTCAAAATAATGGA | 75 | 2764 |
| 1101551 | 15379 | 15398 | CTTAATAAATAATGTGATAA | 94 | 2765 |
| 1101552 | 15381 | 15400 | AACTTAATAAATAATGTGAT | 100 | 2766 |
| 1101553 | 15382 | 15401 | AAACTTAATAAATAATGTGA | 124 | 2767 |
| 1101554 | 15441 | 15460 | CTATGTCCTAAAAGTTTCTC | 77 | 2768 |
| 1101555 | 15442 | 15461 | GCTATGTCCTAAAAGTTTCT | 136 | 2769 |
| 1101556 | 15455 | 15474 | AATTAACATAAAAGCTATGT | 84 | 2770 |
| 1101557 | 15457 | 15476 | GTAATTAACATAAAAGCTAT | 96 | 2771 |
| 1101557 | 15457 | 15476 | GTAATTAACATAAAAGCTAT | 79 | 2771 |
| 1101557 | 15457 | 15476 | GTAATTAACATAAAAGCTAT | 114 | 2771 |
| 1101558 | 15459 | 15478 | AAGTAATTAACATAAAAGCT | 86 | 2772 |
| 1101559 | 15472 | 15491 | TAGTGCAGAAATTAAGTAAT | 98 | 2773 |
| 1101560 | 15479 | 15498 | GGATGGCTAGTGCAGAAATT | 104 | 2774 |
| 1101561 | 15507 | 15526 | CTAGTGCAGAAAATTAGAAG | 96 | 2775 |
| 1101562 | 15513 | 15532 | GGATAGCTAGTGCAGAAAAT | 88 | 2776 |
| 1101563 | 15619 | 15638 | AGAATGAGACATGTAAGTAT | 107 | 2777 |
| 1101564 | 15627 | 15646 | GGTGAAAAGAATGAGACAT | 69 | 2778 |
| 1101565 | 15631 | 15650 | CCTGGGTGAAAAGAATGAG | 70 | 2779 |
| 1101566 | 15633 | 15652 | CACCTGGGTGAAAAGAATG | 106 | 2780 |
| 1101567 | 16440 | 16459 | AACAAAAATTATCTAGATCC | 94 | 2781 |
| 1101568 | 16913 | 16932 | GTTGAGTTTTTATATTTGAT | 69 | 2782 |
| 1101569 | 16915 | 16934 | GGGTTGAGTTTTTATATTTG | 90 | 2783 |
| 1101570 | 19195 | 19214 | AAGATACTACTATAGCATAG | 88 | 2784 |
| 1101571 | 19196 | 19215 | GAAGATACTACTATAGCATA | 78 | 2785 |
| 1101572 | 19197 | 19216 | GGAAGATACTACTATAGCAT | 107 | 2786 |
| 1101573 | 19198 | 19217 | TGGAAGATACTACTATAGCA | 84 | 2787 |

Example 2: Effect of 5-10-5 MOE Gapmers with Mixed Internucleoside Linkages on Human ATXN3 In Vitro, Multiple Doses Modified oligonucleotides selected from the examples above were tested at various doses in A431 cells by free uptake. Compound No. 650528, described in WO 2018/089805, was also tested. Compound No. 650528 is a 5-8-5 MOE gapmer, having a sequence (from 5' to 3') GCATCTTTTCATACTGGC (incorporated herein as SEQ ID NO: 2788), wherein each cytosine is a 5-methyl cytosine, each internucleoside linkage is either a phosphodiester internucleoside linkage or a phosphorothioate internucleoside linkage and the internucleoside linkage motif is sooosssssssssooss, where 's' represents a phosphorothioate internucleoside linkage and 'o' represents a phosphodiester internucleoside linkage, and each of nucleosides 1-5 and 14-18 comprise a 2'-O-methoxyethyl group.

Cells were plated at a density of 10,000 cells per well with 109.4 nM, 437.5 nM, 1,750.0 nM, and 7,000.0 nM concentrations of modified oligonucleotide, as specified in the tables below. After a treatment period of approximately 48 hours, total RNA was isolated from the cells and ATXN3 RNA levels were measured by RT-qPCR Human ATXN3 primer probe set RTS38920 (described hereinabove in Example 1) was used to measure RNA levels. ATXN3 RNA levels were adjusted according to total RNA content, as measured by RiboGreen®. Results are presented in the table below as percent ATXN3 RNA levels relative to untreated control cells. As illustrated in the table below, ATXN3 RNA levels were reduced in a dose-dependent manner in modified oligonucleotide-treated cells. $IC_{50}$ was calculated using the "log(inhibitor) vs. response-variable slope (4 parameters)" formula using Prism6 software.

TABLE 7

Dose-dependent reduction of human ATXN3 RNA by modified oligonucleotides

| Compound Number | ATXN3 level (% control) | | | | $IC_{50}$ (µM) |
|---|---|---|---|---|---|
| | 109.4 nM | 437.5 nM | 1,750.0 nM | 7,000.0 nM | |
| 650528 | 100 | 57 | 39 | 30 | 1.3 |
| 1100379 | 77 | 66 | 37 | 23 | 0.9 |
| 1100384 | 86 | 64 | 35 | 25 | 1.0 |
| 1100397 | 68 | 49 | 25 | 15 | 0.4 |
| 1100398 | 63 | 46 | 26 | 14 | 0.3 |
| 1100399 | 81 | 39 | 39 | 22 | 0.6 |
| 1100403 | 61 | 48 | 32 | 20 | 0.3 |
| 1100405 | 60 | 41 | 25 | 16 | 0.2 |
| 1100406 | 85 | 45 | 24 | 12 | 0.5 |
| 1100407 | 56 | 27 | 15 | 8 | 0.1 |
| 1100408 | 61 | 45 | 21 | 13 | 0.3 |
| 1100409 | 56 | 34 | 19 | 12 | 0.1 |
| 1100410 | 69 | 64 | 38 | 27 | 0.8 |
| 1100429 | 89 | 65 | 38 | 24 | 1.1 |
| 1100430 | 90 | 72 | 53 | 30 | 1.9 |
| 1100434 | 77 | 51 | 30 | 18 | 0.6 |
| 1100468 | 72 | 61 | 44 | 36 | 1.3 |
| 1100475 | 68 | 52 | 28 | 21 | 0.5 |
| 1100479 | 89 | 89 | 56 | 34 | 2.9 |
| 1100557 | 77 | 63 | 47 | 36 | 1.5 |
| 1100559 | 76 | 53 | 29 | 18 | 0.6 |
| 1100560 | 56 | 45 | 27 | 20 | 0.2 |
| 1100566 | 64 | 34 | 13 | 7 | 0.2 |
| 1100567 | 68 | 50 | 31 | 22 | 0.5 |
| 1100568 | 97 | 71 | 41 | 30 | 1.6 |
| 1100571 | 97 | 79 | 38 | 25 | 1.5 |
| 1100572 | 79 | 74 | 45 | 30 | 1.5 |
| 1100574 | 78 | 68 | 46 | 24 | 1.2 |
| 1100580 | 102 | 74 | 43 | 27 | 1.6 |
| 1100583 | 54 | 46 | 26 | 12 | 0.2 |
| 1100584 | 61 | 42 | 23 | 10 | 0.2 |
| 1100585 | 67 | 48 | 25 | 15 | 0.4 |
| 1100589 | 74 | 53 | 32 | 20 | 0.6 |
| 1100590 | 78 | 39 | 17 | 6 | 0.4 |
| 1100591 | 71 | 46 | 26 | 16 | 0.4 |
| 1100592 | 82 | 86 | 56 | 57 | >7.0 |
| 1100597 | 73 | 47 | 26 | 18 | 0.4 |
| 1100641 | 121 | 95 | 78 | 66 | >7.0 |
| 1100666 | 71 | 48 | 31 | 20 | 0.5 |
| 1100667 | 80 | 53 | 38 | 25 | 0.8 |
| 1100668 | 78 | 62 | 39 | 26 | 1.0 |
| 1100669 | 75 | 41 | 23 | 14 | 0.4 |
| 1100673 | 55 | 25 | 15 | 10 | <0.1 |

TABLE 7-continued

Dose-dependent reduction of human ATXN3 RNA by modified oligonucleotides

| Compound Number | ATXN3 level (% control) | | | | $IC_{50}$ (µM) |
|---|---|---|---|---|---|
| | 109.4 nM | 437.5 nM | 1,750.0 nM | 7,000.0 nM | |
| 1100697 | 59 | 49 | 27 | 20 | 0.3 |
| 1100719 | 72 | 60 | 28 | 15 | 0.6 |
| 1100725 | 53 | 30 | 17 | 10 | <0.1 |
| 1100729 | 86 | 70 | 44 | 38 | 1.9 |
| 1100730 | 58 | 41 | 25 | 16 | 0.2 |
| 1100732 | 62 | 43 | 23 | 22 | 0.3 |
| 1100753 | 60 | 52 | 33 | 30 | 0.4 |
| 1100756 | 60 | 48 | 35 | 29 | 0.3 |
| 1100768 | 76 | 52 | 32 | 19 | 0.6 |
| 1100788 | 88 | 72 | 48 | 30 | 1.7 |
| 1100789 | 90 | 67 | 56 | 40 | 2.8 |
| 1100796 | 63 | 48 | 37 | 26 | 0.4 |
| 1100802 | 50 | 34 | 23 | 19 | <0.1 |
| 1100809 | 56 | 44 | 21 | 19 | 0.2 |
| 1100810 | 65 | 41 | 20 | 14 | 0.3 |
| 1100839 | 63 | 36 | 14 | 8 | 0.2 |
| 1100846 | 104 | 78 | 54 | 29 | 2.2 |
| 1100863 | 44 | 31 | 19 | 15 | <0.1 |
| 1100864 | 67 | 35 | 19 | 16 | 0.2 |
| 1100865 | 56 | 34 | 18 | 13 | 0.1 |
| 1100872 | 65 | 40 | 23 | 13 | 0.3 |
| 1100873 | 46 | 36 | 18 | 12 | <0.1 |
| 1100897 | 74 | 50 | 38 | 33 | 0.8 |
| 1100898 | 72 | 57 | 36 | 31 | 0.8 |
| 1100899 | 68 | 52 | 30 | 24 | 0.5 |
| 1100900 | 58 | 41 | 28 | 23 | 0.2 |
| 1100901 | 43 | 32 | 21 | 17 | <0.1 |
| 1100902 | 58 | 35 | 24 | 19 | 0.2 |
| 1100903 | 72 | 53 | 32 | 24 | 0.6 |
| 1100906 | 56 | 42 | 26 | 16 | 0.2 |
| 1100907 | 26 | 26 | 15 | 12 | <0.1 |
| 1100910 | 55 | 40 | 26 | 19 | 0.2 |
| 1100911 | 75 | 48 | 30 | 18 | 0.5 |
| 1100914 | 27 | 12 | 7 | 5 | <0.1 |
| 1100914 | 26 | 11 | 6 | 5 | <0.1 |
| 1100914 | 26 | 12 | 7 | 7 | <0.1 |
| 1100914 | 29 | 11 | 6 | 5 | <0.1 |
| 1100914 | 38 | 16 | 8 | 5 | <0.1 |
| 1100914 | 34 | 13 | 7 | 5 | <0.1 |
| 1100914 | 28 | 13 | 7 | 5 | <0.1 |
| 1100914 | 27 | 13 | 6 | 5 | <0.1 |
| 1100914 | 33 | 14 | 7 | 5 | <0.1 |
| 1100914 | 33 | 12 | 6 | 6 | <0.1 |
| 1100914 | 30 | 13 | 8 | 6 | <0.1 |
| 1100914 | 28 | 15 | 8 | 6 | <0.1 |
| 1100915 | 51 | 23 | 11 | 6 | <0.1 |
| 1100916 | 35 | 22 | 14 | 12 | <0.1 |
| 1100917 | 48 | 29 | 14 | 10 | <0.1 |
| 1100920 | 46 | 30 | 15 | 9 | <0.1 |
| 1100921 | 70 | 54 | 32 | 20 | 0.5 |
| 1100924 | 57 | 34 | 25 | 19 | 0.1 |
| 1100925 | 76 | 52 | 33 | 23 | 0.6 |
| 1100928 | 39 | 28 | 17 | 14 | <0.1 |
| 1100980 | 51 | 39 | 25 | 16 | 0.1 |
| 1100988 | 62 | 41 | 27 | 22 | 0.3 |
| 1100989 | 64 | 38 | 22 | 14 | 0.2 |
| 1100990 | 36 | 25 | 13 | 12 | <0.1 |
| 1100991 | 55 | 35 | 17 | 13 | 0.1 |
| 1100992 | 69 | 49 | 36 | 29 | 0.6 |
| 1100995 | 80 | 74 | 46 | 37 | 1.9 |
| 1100996 | 60 | 44 | 28 | 18 | 0.3 |
| 1100997 | 66 | 40 | 26 | 16 | 0.3 |
| 1100998 | 79 | 68 | 41 | 28 | 1.2 |
| 1100999 | 70 | 58 | 40 | 34 | 0.9 |
| 1101000 | 61 | 39 | 22 | 18 | 0.2 |
| 1101001 | 53 | 43 | 25 | 22 | 0.2 |
| 1101004 | 73 | 57 | 63 | 41 | 3.3 |
| 1101049 | 69 | 47 | 30 | 24 | 0.4 |
| 1101053 | 82 | 39 | 22 | 16 | 0.4 |
| 1101054 | 62 | 47 | 26 | 21 | 0.3 |
| 1101057 | 72 | 57 | 34 | 26 | 0.7 |
| 1101058 | 94 | 65 | 44 | 20 | 1.2 |

TABLE 7-continued

Dose-dependent reduction of human ATXN3 RNA by modified oligonucleotides

| Compound Number | ATXN3 level (% control) | | | | IC$_{50}$ (µM) |
|---|---|---|---|---|---|
| | 109.4 nM | 437.5 nM | 1,750.0 nM | 7,000.0 nM | |
| 1101065 | 60 | 34 | 24 | 20 | 0.2 |
| 1101066 | 69 | 47 | 30 | 22 | 0.4 |
| 1101099 | 55 | 33 | 21 | 16 | 0.1 |
| 1101101 | 40 | 23 | 13 | 12 | <0.1 |
| 1101120 | 66 | 50 | 37 | 30 | 0.5 |
| 1101121 | 71 | 54 | 36 | 20 | 0.6 |
| 1101122 | 77 | 48 | 33 | 25 | 0.6 |
| 1101201 | 60 | 54 | 36 | 34 | 0.5 |
| 1101202 | 35 | 21 | 15 | 13 | <0.1 |
| 1101203 | 56 | 40 | 32 | 30 | 0.2 |
| 1101204 | 53 | 42 | 30 | 28 | 0.1 |
| 1101339 | 77 | 60 | 34 | 24 | 0.8 |
| 1101349 | 54 | 42 | 19 | 11 | 0.2 |
| 1101350 | 63 | 43 | 33 | 18 | 0.3 |
| 1101351 | 79 | 58 | 33 | 24 | 0.8 |
| 1101352 | 97 | 55 | 26 | 13 | 0.8 |
| 1101364 | 76 | 53 | 35 | 24 | 0.7 |
| 1101383 | 62 | 46 | 36 | 27 | 0.4 |
| 1101384 | 57 | 44 | 30 | 19 | 0.2 |
| 1101411 | 63 | 26 | 22 | 18 | 0.1 |
| 1101600 | 72 | 42 | 28 | 15 | 0.4 |
| 1101607 | 84 | 66 | 50 | 40 | 2.2 |
| 1101657 | 82 | 55 | 28 | 20 | 0.7 |
| 1101659 | 88 | 59 | 35 | 20 | 0.9 |
| 1101682 | 78 | 58 | 45 | 28 | 1.1 |
| 1101689 | 91 | 61 | 54 | 44 | 2.9 |
| 1101817 | 111 | 106 | 64 | 38 | 4.3 |
| 1101873 | 65 | 49 | 38 | 35 | 0.6 |
| 1101918 | 81 | 77 | 40 | 32 | 1.6 |
| 1101920 | 52 | 41 | 23 | 11 | 0.1 |
| 1101974 | 26 | 7 | 4 | 4 | <0.1 |
| 1101975 | 32 | 15 | 7 | 5 | <0.1 |
| 1102024 | 63 | 44 | 21 | 10 | 0.3 |
| 1102028 | 41 | 20 | 9 | 6 | <0.1 |
| 1102049 | 61 | 45 | 30 | 19 | 0.3 |
| 1102050 | 61 | 27 | 13 | 8 | 0.1 |
| 1102052 | 63 | 51 | 32 | 26 | 0.4 |
| 1102074 | 41 | 21 | 12 | 6 | <0.1 |
| 1102077 | 73 | 61 | 37 | 25 | 0.8 |
| 1102084 | 59 | 41 | 21 | 18 | 0.2 |
| 1102085 | 55 | 43 | 19 | 15 | 0.2 |
| 1102090 | 69 | 44 | 27 | 20 | 0.4 |
| 1102103 | 83 | 54 | 34 | 19 | 0.7 |
| 1102104 | 55 | 28 | 10 | 8 | <0.1 |
| 1102108 | 79 | 67 | 45 | 21 | 1.1 |
| 1102110 | 87 | 48 | 26 | 14 | 0.6 |
| 1102119 | 109 | 109 | 76 | 60 | >7.0 |
| 1102128 | 77 | 58 | 30 | 16 | 0.6 |
| 1102129 | 83 | 58 | 37 | 28 | 1.0 |
| 1102130 | 58 | 38 | 20 | 13 | 0.2 |
| 1102131 | 73 | 57 | 30 | 16 | 0.6 |
| 1102134 | 84 | 73 | 55 | 34 | 2.3 |
| 1102180 | 82 | 55 | 42 | 32 | 1.1 |
| 1102195 | 83 | 73 | 49 | 36 | 2.1 |
| 1102198 | 60 | 41 | 26 | 15 | 0.2 |
| 1102200 | 95 | 69 | 47 | 27 | 1.6 |
| 1102202 | 91 | 56 | 32 | 19 | 0.8 |
| 1102239 | 78 | 64 | 42 | 33 | 1.3 |
| 1102262 | 88 | 71 | 48 | 34 | 1.9 |
| 1102328 | 60 | 50 | 33 | 21 | 0.3 |
| 1102329 | 65 | 37 | 22 | 11 | 0.2 |
| 1102336 | 58 | 34 | 20 | 13 | 0.2 |
| 1102351 | 66 | 53 | 29 | 28 | 0.5 |
| 1102353 | 69 | 50 | 23 | 11 | 0.4 |
| 1102374 | 78 | 67 | 53 | 36 | 2.0 |
| 1102379 | 67 | 59 | 32 | 21 | 0.6 |
| 1102385 | 69 | 38 | 20 | 15 | 0.3 |
| 1102424 | 79 | 72 | 46 | 27 | 1.4 |
| 1102541 | 63 | 50 | 26 | 17 | 0.3 |
| 1102547 | 94 | 78 | 59 | 51 | >7.0 |
| 1102551 | 87 | 50 | 23 | 11 | 0.6 |
| 1102552 | 67 | 51 | 30 | 28 | 0.5 |
| 1102557 | 74 | 35 | 21 | 10 | 0.3 |
| 1102562 | 73 | 60 | 35 | 20 | 0.7 |
| 1102563 | 64 | 49 | 36 | 22 | 0.4 |
| 1102573 | 82 | 46 | 26 | 18 | 0.6 |
| 1102574 | 61 | 43 | 24 | 17 | 0.2 |
| 1102579 | 62 | 59 | 32 | 22 | 0.5 |
| 1102580 | 67 | 46 | 26 | 16 | 0.4 |
| 1102598 | 93 | 54 | 26 | 14 | 0.7 |
| 1102599 | 66 | 47 | 23 | 11 | 0.3 |
| 1102600 | 77 | 56 | 35 | 22 | 0.7 |
| 1102612 | 71 | 51 | 35 | 24 | 0.6 |
| 1102637 | 92 | 63 | 37 | 21 | 1.1 |
| 1102646 | 75 | 56 | 35 | 30 | 0.8 |
| 1102655 | 82 | 83 | 55 | 38 | 3.1 |
| 1102657 | 71 | 39 | 18 | 12 | 0.3 |
| 1102663 | 63 | 55 | 38 | 27 | 0.5 |
| 1102666 | 58 | 30 | 15 | 9 | 0.1 |
| 1102667 | 73 | 50 | 26 | 15 | 0.5 |
| 1102668 | 88 | 64 | 44 | 32 | 1.5 |
| 1102669 | 67 | 68 | 48 | 32 | 1.4 |
| 1102677 | 68 | 49 | 27 | 20 | 0.4 |
| 1102678 | 65 | 35 | 25 | 17 | 0.2 |
| 1102679 | 72 | 58 | 48 | 36 | 1.3 |
| 1102683 | 55 | 45 | 31 | 17 | 0.2 |
| 1102684 | 82 | 44 | 20 | 12 | 0.5 |
| 1102690 | 68 | 60 | 36 | 33 | 0.8 |
| 1102695 | 90 | 53 | 27 | 18 | 0.7 |
| 1102722 | 67 | 39 | 20 | 9 | 0.3 |
| 1102723 | 71 | 48 | 28 | 21 | 0.5 |
| 1102725 | 48 | 37 | 23 | 10 | <0.1 |
| 1102726 | 88 | 56 | 40 | 25 | 1.0 |
| 1102734 | 81 | 57 | 31 | 19 | 0.7 |
| 1102750 | 69 | 61 | 35 | 23 | 0.7 |
| 1102759 | 69 | 51 | 26 | 24 | 0.4 |
| 1102760 | 73 | 70 | 59 | 47 | 5.5 |
| 1102789 | 76 | 65 | 38 | 23 | 0.9 |
| 1102794 | 55 | 29 | 13 | 8 | <0.1 |
| 1102801 | 80 | 56 | 36 | 29 | 0.9 |
| 1102802 | 77 | 56 | 28 | 23 | 0.6 |
| 1102811 | 29 | 16 | 8 | 6 | <0.1 |
| 1102841 | 64 | 39 | 29 | 23 | 0.3 |

Example 3: Tolerability of Modified Oligonucleotides Complementary to Human ATXN3 in Wild-Type Mice Modified oligonucleotides described above were tested in wild-type female C57/B16 mice to assess the tolerability of the oligonucleotides. Wild-type female C57/B16 mice each received a single ICV dose of 700 µg of modified oligonucleotide listed in the table below. Each treatment group consisted of 2 mice. A group of 2 mice received PBS as a negative control. At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB score). After all 7 criteria were evaluated, the scores were summed for each mouse and averaged within each treatment group. The results are presented in the table below.

TABLE 8

FOB scores in wild-type mice

| Compound Number | 3 hour FOB |
|---|---|
| PBS | 0.00 |
| 1100397 | 0.00 |
| 1100405 | 0.00 |
| 1100406 | 0.00 |
| 1100407 | 1.00 |
| 1100528 | 1.00 |
| 1100534 | 2.00 |
| 1100535 | 2.00 |
| 1100540 | 3.50 |
| 1100542 | 1.50 |
| 1100566 | 3.00 |
| 1100585 | 0.00 |
| 1100590 | 2.00 |
| 1100725 | 3.00 |
| 1100873 | 0.00 |
| 1100914 | 4.50 |
| 1100915 | 5.00 |
| 1100920 | 0.00 |
| 1100990 | 6.50 |
| 1100991 | 5.00 |
| 1101101 | 3.50 |
| 1101339 | 6.00 |
| 1101351 | 1.00 |
| 1101974 | 0.00 |
| 1101975 | 0.00 |
| 1102024 | 0.00 |
| 1102028 | 0.00 |
| 1102050 | 6.50 |
| 1102130 | 0.00 |
| 1102131 | 0.00 |
| 1102336 | 0.00 |
| 1102353 | 0.00 |
| 1102551 | 5.00 |
| 1102557 | 5.50 |
| 1102574 | 0.00 |
| 1102580 | 0.00 |
| 1102599 | 0.00 |
| 1102657 | 0.00 |
| 1102811 | 0.50 |
| 1102970 | 0.00 |
| 1102977 | 0.00 |
| 1102978 | 0.00 |
| 1102979 | 0.00 |
| 1103103 | 2.00 |

TABLE 9

FOB scores in wild-type mice

| Compound Number | 3 hour FOB |
|---|---|
| PBS | 0.00 |
| 1100379 | 0.00 |
| 1100398 | 1.00 |
| 1100399 | 3.00 |
| 1100409 | 4.00 |
| 1100521 | 4.00 |
| 1100527 | 1.00 |
| 1100536 | 3.00 |
| 1100541 | 4.00 |
| 1100544 | 4.00 |
| 1100571 | 3.00 |
| 1100572 | 2.00 |
| 1100667 | 5.50 |
| 1100673 | 1.00 |
| 1100730 | 3.00 |
| 1100732 | 3.00 |
| 1100809 | 1.00 |
| 1100864 | 2.00 |
| 1100865 | 1.00 |
| 1100907 | 4.00 |
| 1100911 | 1.00 |
| 1100980 | 4.00 |
| 1101054 | 2.00 |
| 1101065 | 4.00 |
| 1101121 | 3.00 |
| 1101122 | 2.00 |
| 1101350 | 3.00 |
| 1101352 | 3.00 |
| 1101411 | 1.00 |
| 1101657 | 1.00 |
| 1102084 | 2.00 |
| 1102090 | 3.00 |
| 1102128 | 3.00 |
| 1102198 | 1.00 |
| 1102562 | 3.00 |
| 1102563 | 3.00 |
| 1102612 | 3.00 |
| 1102667 | 1.00 |
| 1102677 | 3.00 |
| 1102683 | 1.00 |
| 1102684 | 1.00 |
| 1102725 | 2.50 |
| 1102980 | 1.00 |
| 1103001 | 3.00 |
| 1103014 | 1.00 |
| 1103069 | 2.00 |

Example 4: Activity of Modified Oligonucleotides Complementary to Human ATXN3 in Transgenic Mice Modified oligonucleotides described above were tested in the ATXN3 YAC transgenic mouse model which contains the full-length human ATXN3 disease gene harboring an expanded CAG repeat ($CAG_{84}$, Q84). The hemizygous SCA3-Q84.2 mice are designated as wt/Q84 and were described in Costa Mdo C., et al., *Toward RNAi Therapy for the Polyglutamine Disease Machado-Joseph Disease*. Mol Ther, 2013. 21 (10): 1898-908." Compound No. 650528, described hereinabove and in WO 2018/089805, was also tested The ATXN3 transgenic mice were divided into groups of 3 mice each. Mice in each group were given a single ICV bolus of oligonucleotide at a dose of 300 μg and sacrificed two weeks later. A group of 4-6 mice was injected with PBS and served as the control group to which oligonucleotide-treated groups were compared. After two weeks, mice were sacrificed and RNA was extracted from brain tissue for real-time PCR analysis of measurement of RNA expression of ATXN3 using primer probe set RTS39540 (forward sequence CCTTCTTCCTGCGCCTTATT, designated herein as SEQ ID NO: 12; reverse sequence TCATGGTG GGTACGTATGTTTAG, designated herein as SEQ ID NO: 13; probe sequence AGTATGCAGGCAAGT CTCCTT CTGT, designated herein as SEQ ID NO: 14). Results are presented as percent change of RNA, relative to PBS control, normalized with cyclophilin A. As shown in the tables below, human ATXN3 RNA was reduced in various tissues.

TABLE 10

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| PBS | 100 | 100 | 100 | 100 |
| 650528 | 29 | 43 | 76 | 30 |
| 1100914 | 17 | 24 | 68 | 16 |
| 1100873 | 48 | 82 | 71 | 57 |
| 1100585 | 56 | 77 | 70 | 54 |
| 1100590 | 21 | 34 | 54 | 73 |
| 1102130 | 33 | 54 | 63 | 22 |
| 1102977 | 45 | 61 | 78 | 33 |
| 1102353 | 33 | 48 | 69 | 57 |
| 1102599 | 28 | 54 | 57 | 42 |
| 1102979 | 34 | 53 | 87 | 34 |
| 1102978 | 60 | 76 | 76 | 37 |
| 1101920 | 55 | 79 | 70 | 68 |
| 1100572 | 56 | 87 | 70 | 70 |
| 1100571 | 33 | 55 | 55 | 79 |
| 1100667 | 59 | 86 | 100 | 39 |

TABLE 11

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| PBS | 100 | 100 | 100 | 100 |
| 650528 | 25 | 42 | 71 | 29 |
| 1100914 | 15 | 19 | 56 | 17 |
| 1100528 | 71 | 67 | 80 | 68 |
| 1100915 | 27 | 27 | 46 | 27 |
| 1100397 | 49 | 58 | 60 | 52 |
| 1100406 | 55 | 58 | 69 | 51 |
| 1102050 | 41 | 46 | 67 | 37 |
| 1102024 | 47 | 41 | 72 | 51 |
| 1101101 | 31 | 37 | 71 | 34 |
| 1102551 | 56 | 62 | 76 | 61 |
| 1102574 | 29 | 40 | 60 | 30 |
| 1102970 | 64 | 60 | 85 | 68 |
| 1102336 | 53 | 42 | 68 | 58 |
| 1102811 | 16 | 22 | 40 | 17 |
| 1102028 | 25 | 25 | 59 | 23 |
| 1100434 | 78 | 75 | 84 | 78 |
| 1100559 | 53 | 41 | 76 | 50 |
| 1101121 | 40 | 46 | 61 | 37 |
| 1100992 | 45 | 49 | 56 | 41 |
| 1100468 | 58 | 59 | 74 | 53 |
| 1100544 | 81 | 62 | 88 | 73 |
| 1100810 | 57 | 95 | 65 | 47 |
| 1100379 | 55 | 54 | 66 | 52 |
| 1100673 | 9 | 12 | 67 | 11 |
| 1102669 | 72 | 69 | 81 | 70 |
| 1102725 | 50 | 49 | 76 | 50 |
| 1103014 | 50 | 52 | 70 | 40 |
| 1102667 | 55 | 111 | 72 | 58 |

TABLE 12

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| PBS | 100 | 100 | 100 | 100 |
| 650528 | 24 | 43 | 80 | 31 |
| 1100914 | 14 | 18 | 59 | 15 |

TABLE 12-continued

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 1100429 | 69 | 72 | 80 | 80 |
| 1100542 | 78 | 78 | 84 | 73 |
| 1100991 | 26 | 51 | 71 | 53 |
| 1100725 | 18 | 27 | 67 | 22 |
| 1102084 | 46 | 72 | 88 | 55 |
| 1101351 | 66 | 87 | 92 | 65 |
| 1102131 | 35 | 36 | 76 | 37 |
| 1103103 | 28 | 42 | 75 | 36 |
| 1102557 | 58 | 79 | 87 | 74 |
| 1102657 | 12 | 19 | 59 | 17 |
| 1100839 | 25 | 40 | 54 | 35 |
| 1100864 | 41 | 68 | 67 | 54 |
| 1100907 | 32 | 49 | 63 | 41 |

TABLE 13

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| PBS | 100 | 100 | 100 | 100 |
| 650528 | 24 | 37 | 93 | 31 |
| 1100914 | 14 | 22 | 68 | 19 |
| 1102108 | 61 | 54 | 88 | 63 |
| 1100697 | 44 | 48 | 75 | 39 |
| 1100902 | 38 | 45 | 83 | 39 |
| 1101383 | 52 | 65 | 101 | 65 |
| 1100900 | 46 | 62 | 92 | 56 |
| 1102562 | 45 | 54 | 64 | 55 |
| 1102637 | 30 | 29 | 50 | 34 |
| 1101203 | 52 | 65 | 70 | 68 |
| 1102612 | 33 | 47 | 73 | 39 |
| 1102198 | 51 | 75 | 96 | 66 |

TABLE 14

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| PBS | 100 | 100 | 100 | 100 |
| 650528 | 28 | 48 | 69 | 31 |
| 1100914 | 20 | 17 | 52 | 16 |
| 1102677 | 83 | 95 | 88 | 86 |
| 1102998 | 41 | 51 | 82 | 47 |
| 1103069 | 25 | 39 | 67 | 29 |
| 1100753 | 39 | 48 | 51 | 37 |

TABLE 15

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| PBS | 100 | 100 | 100 | 100 |
| 650528 | 23 | 38 | 74 | 30 |
| 1100914 | 13 | 15 | 50 | 18 |

TABLE 15-continued

Reduction of human ATXN3 RNA in transgenic mice

|  | hATXN3 Expression (% control) | | | |
| --- | --- | --- | --- | --- |
| Compound Number | Spinal cord | Cortex | Cerebellum | Brain Stem |
| 1100920 | 76 | 86 | 104 | 84 |
| 1101352 | 68 | 84 | 93 | 69 |
| 1101099 | 54 | 68 | 101 | 62 |
| 1100990 | 15 | 41 | 60 | 22 |
| 1100872 | 53 | 65 | 81 | 62 |
| 1101122 | 30 | 23 | 61 | 31 |
| 1100898 | 34 | 37 | 84 | 34 |
| 1101918 | 69 | 93 | 71 | 71 |
| 1100405 | 49 | 58 | 98 | 45 |
| 1102580 | 56 | 79 | 85 | 49 |
| 1100407 | 50 | 63 | 91 | 50 |
| 1101054 | 29 | 31 | 75 | 36 |
| 1101350 | 56 | 74 | 78 | 64 |
| 1101975 | 31 | 58 | 70 | 38 |
| 1100921 | 64 | 86 | 83 | 65 |

TABLE 16

Reduction of human ATXN3 RNA in transgenic mice

|  | hATXN3 Expression (% control) | | | |
| --- | --- | --- | --- | --- |
| Compound Number | Spinal cord | Cortex | Cerebellum | Brain Stem |
| PBS | 100 | 100 | 100 | 100 |
| 650528 | 25 | 54 | 58 | 26 |
| 1100914 | 13 | 13 | 39 | 15 |
| 1100865 | 37 | 37 | 60 | 36 |
| 1100730 | 19 | 26 | 34 | 20 |
| 1100584 | 47 | 45 | 51 | 45 |
| 1101120 | 49 | 65 | 67 | 47 |
| 1100911 | 36 | 52 | 54 | 38 |
| 1102090 | 38 | 50 | 71 | 36 |
| 1102128 | 34 | 41 | 56 | 31 |
| 1100541 | 57 | 72 | 74 | 68 |
| 1100809 | 40 | 48 | 69 | 37 |
| 1102541 | 51 | 75 | 56 | 56 |
| 1102666 | 34 | 52 | 58 | 31 |
| 1100398 | 60 | 64 | 65 | 64 |
| 1100399 | 46 | 49 | 59 | 47 |
| 1100410 | 52 | 69 | 70 | 48 |
| 1100732 | 55 | 80 | 72 | 58 |

TABLE 17

Reduction of human ATXN3 RNA in transgenic mice

|  | hATXN3 Expression (% control) | | | |
| --- | --- | --- | --- | --- |
| Compound Number | Spinal cord | Cortex | Cerebellum | Brain Stem |
| PBS | 100 | 100 | 100 | 100 |
| 650528 | 21 | 38 | 67 | 26 |
| 1100914 | 14 | 18 | 43 | 16 |
| 1100557 | 53 | 78 | 78 | 74 |
| 1100980 | 23 | 45 | 80 | 24 |
| 1102600 | 48 | 55 | 86 | 44 |
| 1102980 | 41 | 43 | 67 | 43 |
| 1101657 | 17 | 23 | 57 | 19 |
| 1102684 | 65 | 85 | 110 | 73 |
| 1101202 | 28 | 33 | 66 | 27 |
| 1101659 | 29 | 39 | 77 | 27 |
| 1102103 | 36 | 43 | 81 | 41 |
| 1101873 | 41 | 49 | 80 | 41 |
| 1102202 | 69 | 78 | 98 | 70 |
| 1102180 | 68 | 72 | 106 | 75 |

TABLE 17-continued

Reduction of human ATXN3 RNA in transgenic mice

|  | hATXN3 Expression (% control) | | | |
| --- | --- | --- | --- | --- |
| Compound Number | Spinal cord | Cortex | Cerebellum | Brain Stem |
| 1102239 | 63 | 68 | 92 | 82 |
| 1102678 | 73 | 79 | 92 | 77 |
| 1102052 | 68 | 83 | 100 | 72 |

TABLE 18

Reduction of human ATXN3 RNA in transgenic mice

|  | hATXN3 Expression (% control) | | | |
| --- | --- | --- | --- | --- |
| Compound Number | Spinal cord | Cortex | Cerebellum | Brain Stem |
| PBS | 100 | 100 | 100 | 100 |
| 650528 | 28 | 35 | 83 | 27 |
| 1100914 | 13 | 11 | 46 | 12 |
| 1102129 | 28 | 26 | 56 | 20 |
| 1101053 | 42 | 56 | 97 | 43 |
| 1100430 | 81 | 75 | 76 | 78 |
| 1100666 | 50 | 44 | 70 | 47 |
| 1100756 | 45 | 64 | 71 | 42 |
| 1102598 | 33 | 31 | 56 | 30 |
| 1100863 | 52 | 53 | 77 | 52 |
| 1102646 | 63 | 80 | 87 | 62 |
| 1102750 | 59 | 66 | 70 | 57 |
| 1100802 | 29 | 36 | 61 | 36 |
| 1100906 | 44 | 46 | 69 | 52 |
| 1102379 | 64 | 69 | 94 | 72 |
| 1102663 | 60 | 83 | 63 | 69 |
| 1102679 | 80 | 93 | 92 | 92 |

Example 5: Tolerability of Modified Oligonucleotides Complementary to Human ATXN3 in Wild-Type Mice Modified oligonucleotides described above were tested in wild-type female C57/B16 mice to assess the tolerability of the oligonucleotides. Wild-type female C57/B16 mice each received a single ICV dose of 700 μg of modified oligonucleotide listed in the table below. Each treatment group consisted of 4 mice. A group of 3-4 mice received PBS as a negative control. Also tested in several studies were comparator Compound No. 650528, a 5-8-5 MOE gapmer with mixed PO/PS internucleoside linkages complementary to human ATXN3 described hereinabove and in WO 2018/089805 and the following LNA comparator compounds: Compound No. 1244463 (a 3-9-3 LNA gapmer with uniform PS internucleoside linkages complementary to human ATXN3); Compound No. 1244464 (a 3-10-3 LNA gapmer with uniform PS internucleoside linkages complementary to human ATXN3); Compound No. 1244465 (a 3-10-3 LNA gapmer with uniform PS internucleoside linkages complementary to human ATXN3); Compound No. 1244466 (a 3-9-3 LNA gapmer with uniform PS internucleoside linkages complementary to human ATXN3); and Compound No. 1244467 (a 2-9-3 LNA gapmer with uniform PS internucleoside linkages complementary to human ATXN3), described in WO2013/138353 were tested.

At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB score). After all 7 criteria were evaluated, the scores were summed for each mouse and averaged within each treatment group. The results are presented in the table below.

TABLE 19

FOB scores in wild-type mice

| Compound Number | 3 hour FOB |
|---|---|
| PBS | 0.00 |
| 650528 | 0.00 |
| 1100559 | 4.00 |
| 1100802 | 5.75 |
| 1100839 | 4.25 |
| 1100898 | 0.00 |
| 1100914 | 5.25 |
| 1101202 | 5.25 |
| 1101659 | 1.50 |
| 1102129 | 2.75 |
| 1102598 | 0.00 |
| 1102637 | 3.50 |

TABLE 20

FOB scores in wild-type mice

| Compound Number | 3 hour FOB |
|---|---|
| 650528 | 0.00 |
| 1100408 | 6.25 |
| 1100673 | 0.00 |
| 1100725 | 4.50 |
| 1100730 | 2.75 |
| 1100914 | 4.00 |
| 1100917 | 6.00 |
| 1101000 | 4.75 |
| 1101122 | 3.25 |
| 1101657 | 0.00 |
| 1102130 | 0.00 |
| 1102131 | 0.75 |
| 1102574 | 1.00 |
| 1102811 | 2.25 |

TABLE 21

FOB scores in wild-type mice

| Compound Number | 3 hour FOB |
|---|---|
| PBS | 0.00 |
| 1100369 | 0.25 |
| 1100479 | 3.25 |
| 1100505 | 5.00 |
| 1100508 | 6.00 |
| 1101375 | 0.00 |
| 1101721 | 5.00 |
| 1101853 | 0.00 |
| 1102690* | 0.00 |
| 1102706 | 1.00 |
| 1102808 | 1.75 |
| 1103041 | 3.00 |

TABLE 22

FOB scores in wild-type mice

| Compound Number | 3 hour FOB |
|---|---|
| PBS | 0.00 |
| 1101736 | 0.00 |

TABLE 23

FOB scores in wild-type mice

| Compound Number | 3 hour FOB |
|---|---|
| PBS | 0.00 |
| 1100505 | 4.00 |
| 1100506 | 1.50 |
| 1100672 | 0.00 |
| 1100731 | 1.25 |
| 1102811 | 2.25 |
| 1103041 | 3.25 |

TABLE 24

FOB scores in wild-type mice

| Compound Number | 3 hour FOB |
|---|---|
| PBS | 0.00 |
| 1100723 | 0.00 |
| 1100724 | 1.00 |
| 1100728 | 0.75 |
| 1100729 | 0.50 |

TABLE 25

FOB scores in wild-type mice

| Compound Number | 3 hour FOB |
|---|---|
| PBS | 0.00 |
| 1100506 | 2.00 |
| 1100731 | 3.75 |

TABLE 26

FOB scores in wild-type mice

| Compound Number | 3 hour FOB |
|---|---|
| PBS | 0.00 |
| 1244463 | 7.00 |
| 1244464 | 7.00 |
| 1244465 | 7.00 |
| 1244466 | 7.00 |
| 1244467 | 7.00 |

Example 6: Activity of Modified Oligonucleotides Complementary to Human ATXN3 RNA in Transgenic Mice Modified oligonucleotides were tested in the ATXN3 YAC transgenic mouse model which contains the full-length human ATXN3 disease gene harboring an expanded CAG repeat ($CAG_{84}$, Q84). The hemizygous SCA3-Q84.2 mice are designated as wt/Q84 and were described in Costa Mdo C., et al., *Toward RNAi Therapy for the Polyglutamine Disease Machado-Joseph Disease*. Mol Ther, 2013. 21 (10): 1898-908.

The ATXN3 transgenic mice were divided into groups of 2-3 mice each. Mice in each group were given a single ICV bolus of oligonucleotide at a dose of 300 μg and sacrificed two weeks later. A group of 2 to 5 mice was injected with PBS and served as the control group to which oligonucleotide-treated groups were compared. After two weeks, mice were sacrificed, and RNA was extracted from various regions of the central nervous system. ATXN3 RNA levels were measured by quantitative real-time RTPCR using human primer probe set RTS43981 (forward sequence TGACACAGACATCAGGTACAAATC, designated herein as SEQ ID NO: 2798; reverse sequence TGCTGCTGTTG CTGCTT, designated herein as SEQ ID NO: 2799; probe sequence AGCTTCGGAAGAGACGAGAAGCCTA, designated herein as SEQ ID NO: 2800). Results are presented as percent change of RNA, relative to PBS control, normalized to mouse cyclophilin A measured using mouse primer probe set m_cyclo24 (forward sequence TCGCCGCTTGC TGCA, designated herein as SEQ ID NO: 2801; reverse sequence ATCGGCCGTGATGTCGA, designated herein as SEQ ID NO: 2802; probe sequence CCATGGTCAACCC-CACCGTGTTC, designated herein as SEQ ID NO: 2803). Also tested in several studies was comparator Compound No. 650528, a 5-8-5 MOE gapmer with mixed PO/PS internucleoside linkages complementary to human ATXN3 described hereinabove and in WO 2018/089805. As shown in the tables below, human ATXN3 RNA was reduced in various tissues.

TABLE 27

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 38 | 41 | 79 | 40 |
| 1100408 | 28 | 40 | 68 | 32 |
| 1100409 | 30 | 55 | 59 | 36 |
| 1100521 | 68 | 87 | 83 | 74 |
| 1100527 | 76 | 83 | 79 | 82 |
| 1100534 | 57 | 71 | 97 | 59 |
| 1100535 | 77 | 96 | 100 | 84 |
| 1100536 | 76 | 103 | 80 | 90 |
| 1100540 | 67 | 69 | 89 | 68 |
| 1100566 | 68 | 94 | 85 | 74 |
| 1100673 | 17 | 14 | 53 | 16 |
| 1100914 | 23 | 17 | 50 | 24 |
| 1101000 | 34 | 37 | 69 | 34 |
| 1101065 | 43 | 62 | 66 | 42 |
| 1101339 | 51 | 56 | 78 | 57 |
| 1101411 | 29 | 52 | 56 | 30 |
| 1101974 | 17 | 22 | 50 | 19 |
| 1102329 | 46 | 48 | 73 | 49 |
| 1102563 | 42 | 45 | 78 | 41 |
| 1102657 | 20 | 18 | 52 | 19 |
| 1102683 | 27 | 29 | 60 | 27 |
| 1102811 | 27 | 38 | 66 | 23 |
| 1103001 | 45 | 53 | 71 | 52 |

TABLE 28

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 30 | 42 | 67 | 34 |
| 1100670 | 61 | 75 | 72 | 54 |
| 1100671 | 60 | 70 | 73 | 45 |
| 1100674 | 64 | 74 | 84 | 58 |
| 1100910 | 34 | 43 | 62 | 37 |
| 1100912 | 55 | 52 | 71 | 53 |
| 1100917 | 38 | 32 | 68 | 35 |

TABLE 29

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 39 | 61 | 81 | 38 |
| 1100505 | 32 | 38 | 64 | 34 |
| 1100522 | 59 | 85 | 89 | 64 |
| 1100523 | 88 | 103 | 83 | 96 |
| 1100597 | 63 | 85 | 85 | 71 |
| 1100914 | 22 | 29 | 63 | 28 |
| 1101349 | 45 | 70 | 71 | 52 |
| 1101370 | 67 | 107 | 97 | 71 |
| 1101600 | 41 | 47 | 70 | 44 |
| 1102328 | 39 | 57 | 66 | 37 |
| 1102794 | 51 | 71 | 86 | 62 |
| 1102939 | 63 | 63 | 87 | 76 |
| 1102941 | 50 | 80 | 84 | 60 |
| 1103073 | 44 | 73 | 68 | 51 |
| 1103116 | 44 | 63 | 78 | 47 |

TABLE 30

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 32 | 48 | 74 | 34 |
| 1100369 | 22 | 40 | 54 | 30 |
| 1100382 | 64 | 78 | 66 | 53 |
| 1100384 | 56 | 94 | 67 | 53 |
| 1100454 | 44 | 72 | 49 | 45 |
| 1101388 | 58 | 53 | 74 | 48 |
| 1101601 | 56 | 62 | 62 | 58 |
| 1101615 | 81 | 108 | 85 | 82 |
| 1101721 | 21 | 46 | 61 | 29 |
| 1101755 | 53 | 82 | 59 | 60 |
| 1101926 | 67 | 87 | 71 | 63 |
| 1101992 | 93 | 89 | 78 | 79 |
| 1102043 | 71 | 86 | 69 | 60 |
| 1102062 | 45 | 70 | 66 | 55 |
| 1102147 | 58 | 55 | 56 | 48 |
| 1102166 | 72 | 85 | 69 | 56 |
| 1102216 | 39 | 52 | 60 | 42 |
| 1102322 | 71 | 88 | 67 | 62 |
| 1102361 | 66 | 106 | 75 | 80 |
| 1102424 | 52 | 72 | 68 | 61 |
| 1102692 | 62 | 59 | 64 | 54 |
| 1102793 | 64 | 107 | 76 | 81 |
| 1103067 | 61 | 104 | 75 | 86 |
| 1103077 | 64 | 82 | 74 | 66 |
| 1103084 | 37 | 60 | 69 | 53 |

TABLE 31

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 49 | 30 | 90 | 43 |
| 1100479 | 57 | 34 | 71 | 47 |
| 1101375 | 59 | 45 | 74 | 48 |
| 1101609 | 86 | 84 | 104 | 83 |
| 1101667 | 84 | 68 | 100 | 82 |
| 1101764 | 85 | 68 | 93 | 72 |
| 1101853 | 65 | 45 | 78 | 53 |
| 1101962 | 79 | 59 | 92 | 67 |
| 1102195 | 111 | 65 | 98 | 73 |
| 1102426 | 76 | 61 | 79 | 69 |
| 1102690 | 53 | 33 | 80 | 42 |
| 1102787 | 78 | 65 | 106 | 87 |
| 1102808 | 65 | 47 | 88 | 58 |
| 1102865 | 92 | 72 | 101 | 81 |
| 1102957 | 75 | 58 | 81 | 71 |
| 1102981 | 76 | 56 | 94 | 66 |
| 1102997 | 85 | 62 | 97 | 74 |
| 1103105 | 68 | 49 | 85 | 56 |

TABLE 32

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 38 | 43 | 84 | 42 |
| 1100514 | 70 | 79 | 87 | 81 |
| 1101616 | 48 | 50 | 75 | 57 |
| 1101683 | 71 | 83 | 90 | 88 |
| 1101689 | 61 | 73 | 85 | 71 |
| 1101786 | 87 | 101 | 113 | 99 |
| 1101811 | 66 | 90 | 90 | 73 |
| 1101817 | 88 | 73 | 98 | 96 |
| 1101828 | 89 | 102 | 97 | 104 |
| 1102097 | 75 | 90 | 100 | 83 |
| 1102144 | 58 | 73 | 86 | 74 |
| 1102162 | 71 | 79 | 90 | 81 |
| 1102220 | 57 | 54 | 84 | 59 |
| 1102228 | 78 | 102 | 108 | 103 |
| 1102283 | 52 | 57 | 84 | 63 |
| 1102335 | 69 | 91 | 100 | 73 |
| 1102589 | 86 | 95 | 101 | 93 |
| 1102648 | 73 | 83 | 84 | 82 |
| 1102706 | 39 | 36 | 69 | 38 |
| 1102746 | 61 | 64 | 94 | 69 |
| 1102757 | 40 | 62 | 74 | 49 |
| 1102761 | 47 | 60 | 73 | 58 |
| 1102792 | 68 | 80 | 92 | 79 |
| 1102876 | 46 | 50 | 81 | 55 |
| 1102974 | 102 | 106 | 109 | 104 |

TABLE 33

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 32 | 42 | 77 | 39 |
| 1100475 | 46 | 51 | 78 | 37 |
| 1100508 | 33 | 28 | 30 | 29 |
| 1101718 | 45 | 40 | 71 | 49 |
| 1101808 | 76 | 87 | 78 | 78 |

TABLE 33-continued

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 1101821 | 73 | 75 | 79 | 68 |
| 1101912 | 67 | 74 | 87 | 53 |
| 1101927 | 77 | 80 | 75 | 75 |
| 1101958 | 72 | 66 | 68 | 44 |
| 1102073 | 61 | 68 | 69 | 63 |
| 1102074 | 42 | 47 | 72 | 42 |
| 1102110 | 80 | 88 | 87 | 78 |
| 1102385 | 42 | 58 | 75 | 40 |
| 1102555* | 86 | 85 | 79 | 64 |
| 1102722 | 78 | 91 | 80 | 75 |
| 1102734 | 43 | 69 | 77 | 50 |
| 1102789 | 65 | 73 | 82 | 59 |
| 1102848 | 76 | 92 | 96 | 84 |
| 1102953 | 80 | 82 | 81 | 78 |
| 1103012 | 80 | 90 | 79 | 70 |
| 1103041 | 34 | 23 | 61 | 35 |

*Group has only 1 animal

TABLE 34

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 36 | 47 | 81 | 44 |
| 1101736 | 33 | 32 | 61 | 38 |
| 1102060 | 57 | 53 | 82 | 56† |
| 1102106 | 50 | 64 | 78 | 62 |
| 1102134 | 94 | 94 | 98 | 100 |
| 1102334 | 77 | 66 | 85 | 71 |
| 1102374 | 61 | 69 | 104 | 66 |
| 1102567 | 68 | 67 | 81 | 66 |
| 1102695 | 52 | 71 | 88 | 63 |
| 1102758 | 59 | 52 | 78 | 55 |
| 1102779 | 39 | 50 | 86 | 48 |
| 1102805 | 70 | 71 | 84† | 75 |
| 1102898 | 63 | 71 | 73† | 70 |
| 1103000 | 71 | 82 | 100 | 77 |
| 1103006 | 72 | 63 | 85 | 72 |
| 1103072 | 75 | 73 | 86 | 66 |

†Average of 2 PCR points

TABLE 35

Reduction of human ATXN3 RNA in transgenic mice

| Compound Number | hATXN3 Expression (% control) | | | |
|---|---|---|---|---|
| | Spinal cord | Cortex | Cerebellum | Brain Stem |
| 650528 | 28 | 43 | 76 | 32 |
| 1101974 | 13 | 10 | 48 | 15 |
| 1102130 | 21 | 29 | 73 | 23 |
| 1102132 | 86 | 70 | 91 | 70 |
| 1102133 | 85 | 86 | 101 | 85 |

TABLE 36

Reduction of human ATXN3 RNA in transgenic mice

| Compound Number | Spinal cord | Cortex | Cerebellum | Brain Stem |
|---|---|---|---|---|
| 650528 | 40 | 33 | 78 | 44 |
| 1101657 | 28 | 22 | 66 | 32 |
| 1102028 | 33 | 28 | 63 | 30 |
| 1102637 | 40 | 27 | 69 | 42 |
| 1102638 | 39 | 29 | 95 | 43 |
| 1102639 | 34 | 31 | 121 | 37 |
| 1102640 | 56 | 58 | 75 | 57 |
| 1102642 | 67 | 64 | 87 | 65 |

TABLE 37

Reduction of human ATXN3 RNA in transgenic mice hATXN3 Expression (% control)

| Compound Number | Spinal cord | caudal cortex | Cerebellum | Brain Stem |
|---|---|---|---|---|
| 650528 | 28 | 49 | 68 | 40 |
| 1100723 | 40† | 60 | 62 | 53 |
| 1100724 | 45 | 43 | 69 | 52 |
| 1100725 | 28 | 39 | 60 | 34 |
| 1100726 | 57 | 79 | 67 | 60 |
| 1100727 | 58 | 51 | 80 | 57 |
| 1100728 | 38 | 45 | 67 | 50 |
| 1100729 | 37 | 39 | 63 | 48 |
| 1102683 | 31 | 23 | 55 | 27 |

†Average of 2 PCR points

TABLE 38

Reduction of human ATXN3 RNA in transgenic mice hATXN3 Expression (% control)

| Compound Number | Spinal cord | caudal cortex | Cerebellum | Brain Stem |
|---|---|---|---|---|
| 650528 | 38 | 39 | 80 | 31 |
| 1102574 | 32 | 41 | 70 | 34 |
| 1102595 | 102 | 94 | 98† | 72 |
| 1102596 | 103 | 91 | 97 | 92 |
| 1102597 | 89 | 94 | 96 | 78 |
| 1102598 | 39 | 28 | 62 | 35 |
| 1102599 | 40 | 54 | 78 | 34 |
| 1102600 | 37 | 53 | 75 | 33 |
| 1102601 | 50 | 58 | 80 | 43 |
| 1102602 | 70 | 73 | 95 | 60 |
| 1102603 | 94 | 101 | 97 | 84 |
| 1102604 | 108 | 101 | 108 | 80 |
| 1102605 | 102 | 103 | 106 | 82 |

†Average of 2 PCR points

TABLE 39

Reduction of human ATXN3 RNA in transgenic mice hATXN3 Expression (% control)

| Compound Number | Spinal cord | caudal cortex | Cerebellum | Brain Stem |
|---|---|---|---|---|
| 650528 | 39 | 46 | 39 | 54† |
| 1100505 | 46 | 55 | 41 | 49 |
| 1100506 | 57 | 60 | 37 | 62 |
| 1100672 | 37 | 36 | 46 | 32 |
| 1100731 | 35 | 33 | 32 | 33 |
| 1102811 | 19 | 24 | 29 | 23 |
| 1103041 | 36 | 26 | 37 | 29 |

†Average of 2 PCR points

Example 7: Effect of 5-10-5 MOE Gapmers with Mixed Internucleoside Linkages on Human ATXN3 In Vitro, Multiple Doses Modified oligonucleotides selected from the examples above were tested at various doses in A431 cells by free uptake. Also tested was comparator Compound No. 650528, a 5-8-5 MOE gapmer with mixed PO/PS internucleoside linkages complementary to human ATXN3, described hereinabove and in WO 2018/089805.

Cells were plated at a density of 10,000 cells per well, and treated with 109.4 nM, 437.5 nM, 1,750.0 nM, and 7,000.0 nM concentrations of modified oligonucleotide, as specified in the tables below. After a treatment period of approximately 48 hours, total RNA was isolated from the cells and ATXN3 RNA levels were measured by RT-qPCR. Human ATXN3 primer probe set RTS38920 (described hereinabove in Example 1) was used to measure RNA levels. ATXN3 RNA levels were adjusted according to total RNA content, as measured by RiboGreen®. In addition, ATXN3 RNA levels were also normalized to human GAPDH levels measured by human GAPDH primer-probe set RTS104 (forward sequence GAAGGTGAAGGTCGGAGTC, designated herein as SEQ ID NO: 2804; reverse sequence GAAGAT GGTGATGGGATTTC, designated herein as SEQ ID NO: 2805; probe sequence CAAGCTTCCCGTTCTCAGCC, designated herein as SEQ ID NO: 2806). Results are presented in the table below as percent ATXN3 RNA levels relative to untreated control cells. $IC_{50}$ was calculated using the "log (inhibitor) vs. normalized response—variable slope" formula using Prism7.01 software. In some cases, an $IC_{50}$ could not be reliably calculated and the data point is marked as "N.C.".

TABLE 40

Dose-dependent reduction of human ATXN3 RNA by modified oligonucleotides

ATXN3 level (% control) normalized to ribogreen

| Compound Number | 109.4 nM | 437.5 nM | 1,750.0 nM | 7000.0 nM | $IC_{50}$ (µM) |
|---|---|---|---|---|---|
| 650528 | 84 | 67 | 48 | 38 | 2.03 |
| 1100673 | 50 | 21 | 11 | 9 | 0.10 |
| 1100914 | 26 | 12 | 7 | 5 | <0.10 |
| 1101657 | 93 | 53 | 31 | 17 | 0.69 |
| 1102130 | 85 | 46 | 24 | 13 | 0.47 |

Example 8: Tolerability of Modified Oligonucleotides Complementary to Human ATXN3 in Rats, 3 mg Dose Modified oligonucleotides described above were tested in rats to assess the tolerability of the oligonucleotides.

Sprague Dawley rats each received a single intrathecal (IT) dose of 3 mg of oligonucleotide listed in the table below. Each treatment group consisted of 4 rats. A group of four rats received PBS as a negative control. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed. After each of the 7 body parts were evaluated, the sub-scores were summed for each rat and then averaged for each group. For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Results are presented as the average score for each treatment group. A comparator compound, 650528, a 5-8-5 MOE gapmer with mixed PO/PS internucleoside linkages complementary to human ATXN3 described hereinabove and in WO 2018/089805 was also tested.

TABLE 41

Tolerability scores in rats at 3 mg dose

| Compound Number | 3 hour FOB |
|---|---|
| PBS | 0.00 |
| 1100397 | 1.50 |
| 1100405 | 1.50 |
| 1100406 | 1.25 |
| 1100407 | 2.75 |
| 1100528 | 1.50 |
| 1100534 | 2.75 |
| 1100535 | 3.75 |
| 1100540 | 3.00 |
| 1100542 | 1.00 |
| 1100566 | 3.00 |
| 1100585 | 0.25 |
| 1100590 | 2.50 |
| 1100725 | 3.00 |
| 1100873 | 1.50 |
| 1100914 | 3.25 |
| 1100915 | 5.50 |
| 1100920 | 2.25 |
| 1100990 | 4.50 |
| 1100991 | 3.75 |

TABLE 42

Tolerability scores in rats at 3 mg dose

| Compound Number | 3 hour FOB |
|---|---|
| PBS | 0.00 |
| 1101101 | 4.50 |
| 1101339 | 5.75 |
| 1101351 | 2.25 |
| 1101974 | 2.25 |
| 1101975 | 1.75 |
| 1102024 | 2.00 |
| 1102028 | 0.75 |
| 1102050 | 5.00 |
| 1102130 | 2.00 |
| 1102131 | 2.00 |

TABLE 43

Tolerability scores in rats at 3 mg dose

| Compound Number | 3 hour FOB |
|---|---|
| PBS | 0.00 |
| 1102336 | 2.25 |
| 1102353 | 1.75 |
| 1102551 | 3.00 |
| 1102557 | 2.75 |
| 1102574 | 3.00 |
| 1102580 | 1.75 |
| 1102599 | 0.75 |
| 1102657 | 1.00 |
| 1102811 | 2.00 |
| 1102970 | 3.00 |
| 1102977 | 0.75 |
| 1102978 | 1.50 |
| 1102979 | 1.50 |
| 1103103 | 3.25 |

TABLE 44

Tolerability scores in rats at 3 mg dose

| Compound Number | 3 hour FOB |
|---|---|
| PBS | 0.00 |
| 1100379 | 1.50 |
| 1100398 | 2.00 |
| 1100399 | 2.75 |
| 1100408 | 4.00 |
| 1100409 | 2.50 |
| 1100521 | 4.00 |
| 1100527 | 2.00 |
| 1100536 | 4.50 |
| 1100541 | 6.00 |
| 1100544 | 3.00 |
| 1100839 | 3.00 |
| 1101000 | 4.00 |
| 1101920 | 1.75 |
| 1102329 | 3.25 |
| 1102666 | 3.00 |

TABLE 45

Tolerability scores in rats at 3 mg dose

| Compound Number | 3 hour FOB |
|---|---|
| PBS | 0.00 |
| 1100571 | 1.50 |
| 1100572 | 1.25 |
| 1100667 | 0.00 |
| 1100730 | 3.25 |
| 1100732 | 3.25 |
| 1100809 | 1.25 |
| 1100864 | 3.25 |
| 1100865 | 2.75 |
| 1100907 | 3.25 |
| 1100911 | 0.50 |
| 1100980 | 4.00 |
| 1101054 | 4.00 |
| 1101065 | 2.75 |

TABLE 46

Tolerability scores in rats at 3 mg dose

| Compound Number | 3 hour FOB |
|---|---|
| PBS | 0.00 |
| 1101121 | 2.25 |
| 1101122 | 3.25 |
| 1101350 | 4.00 |
| 1101352 | 3.25 |
| 1101411 | 1.00 |
| 1101657 | 0.25 |
| 1102084 | 2.50 |
| 1102090 | 2.50 |
| 1102128 | 2.75 |
| 1102198 | 3.00 |
| 1102562 | 2.00 |
| 1102563 | 3.50 |
| 1102612 | 2.25 |
| 1102667 | 1.75 |

TABLE 47

Tolerability scores in rats at 3 mg dose

| Compound Number | 3 hour FOB |
|---|---|
| PBS | 0.00 |
| 1100410 | 3.50 |
| 1100468 | 0.25 |
| 1100557 | 1.00 |
| 1102541 | 0.75 |
| 1102600 | 0.50 |
| 1102637 | 0.00 |
| 1102677 | 4.00 |
| 1102683 | 0.25 |
| 1102725 | 0.50 |
| 1102980 | 1.25 |
| 1103001 | 2.75 |
| 1103014 | 0.50 |
| 1103069 | 1.00 |

TABLE 48

Tolerability scores in rats at 3 mg dose

| Compound Number | 3 hour FOB |
|---|---|
| PBS | 0.50 |
| 1100584 | 0.25 |
| 1100697 | 0.25 |
| 1100753 | 0.00 |
| 1100810 | 1.75 |
| 1100872 | 1.50 |
| 1100898 | 2.00 |
| 1100900 | 1.00 |
| 1100902 | 0.25 |
| 1100921 | 0.50 |
| 1100992 | 0.00 |
| 1101099 | 3.25 |
| 1101120 | 2.00 |
| 1101203 | 1.50 |
| 1101918 | 1.00 |

TABLE 49

Tolerability scores in rats at 3 mg dose

| Compound Number | 3 hour FOB |
|---|---|
| PBS | 0.00 |
| 1100559 | 0.25 |
| 1101053 | 0.00 |
| 1101202 | 0.00 |
| 1101383 | 0.25 |
| 1101659 | 0.00 |
| 1101873 | 0.75 |
| 1102052 | 0.00 |
| 1102103 | 0.25 |
| 1102108 | 0.00 |
| 1102129 | 0.25 |
| 1102180 | 0.00 |
| 1102202 | 0.00 |
| 1102239 | 0.00 |
| 1102678 | 0.00 |
| 1102998 | 2.00 |

TABLE 50

Tolerability scores in rats at 3 mg dose

| Compound Number | 3 hour FOB |
|---|---|
| PBS | 0.00 |
| 650528 | 0.50 |
| 1100429 | 0.00 |
| 1100430 | 0.00 |
| 1100434 | 0.25 |
| 1100666 | 0.25 |
| 1100756 | 0.00 |
| 1100802 | 0.50 |
| 1100863 | 0.00 |
| 1100906 | 0.25 |
| 1102379 | 0.50 |
| 1102598 | 1.75 |
| 1102646 | 0.00 |
| 1102663 | 0.00 |
| 1102669 | 0.00 |
| 1102679 | 0.00 |
| 1102750 | 0.00 |

TABLE 51

Tolerability scores in rats at 3 mg dose

| Compound Number | 3 hour FOB |
|---|---|
| PBS | 0.00 |
| 1100369 | 4.00 |
| 1100479 | 5.00 |
| 1100505 | 6.00 |
| 1100508 | 6.00 |
| 1101375 | 3.00 |
| 1101721 | 5.75 |
| 1101853 | 4.00 |
| 1102690 | 1.25 |
| 1102706 | 4.50 |
| 1102808 | 5.00 |
| 1103041 | 4.75 |

TABLE 52

Tolerability scores in rats at 3 mg dose

| Compound Number | 3 hour FOB |
|---|---|
| PBS | 0.00 |
| 1100505 | 5.00 |
| 1100506 | 2.25 |
| 1100729 | 2.25 |

TABLE 53

Tolerability scores in rats at 3 mg dose

| Compound Number | 3 hour FOB |
|---|---|
| PBS | 0.00 |
| 1100672 | 0.00 |
| 1100731 | 3.00 |

TABLE 54

Tolerability scores in rats at 3 mg dose

| Compound Number | 3 hour FOB |
|---|---|
| PBS | 0.25 |
| 1100731 | 4.00 |

TABLE 55

Tolerability scores in rats at 3 mg dose

| Compound Number | 3 hour FOB |
|---|---|
| PBS | 0.00 |
| 1100723 | 0.50 |
| 1100724 | 2.25 |
| 1100728 | 0.75 |

TABLE 56

Tolerability scores in rats at 3 mg dose

| Compound Number | 3 hour FOB |
|---|---|
| PBS | 0.00 |
| 1100673 | 0.00 |

Example 9: Activity of Modified Oligonucleotides Complementary to Human ATXN3 in Transgenic Mice, Multiple Dose Modified oligonucleotides described above were tested in the ATXN3 YAC transgenic mouse model which contains the full-length human ATXN3 disease gene harboring an expanded CAG repeat (CAG84, Q84) previously described herein.

The ATXN3 transgenic mice were divided into groups of 4 mice each. Mice in each group were given a single ICV bolus of oligonucleotide at a dose of 10 µg, 30 µg, 100 µg, 300 µg, or 700 µg, and sacrificed two weeks later. A group of 3-4 mice was injected with PBS and served as the control group to which oligonucleotide-treated groups were compared. After two weeks, mice were sacrificed, and RNA was extracted from brain cortex, spinal cord, brain stem and/or cerebellum for real-time PCR analysis of measurement of RNA expression of ATXN3 using primer probe set RTS43981. Results are presented as percent change of RNA, relative to PBS control, normalized to mouse cyclophilin A measured using mouse primer probe set m_cyclo24 as previously described herein. As shown in the tables below, human ATXN3 RNA was reduced in various tissues. $ED_{50}$ was calculated for the compounds using the "non-linear fit of transform ED50" formula in GraphPad Prism 7.01. In some cases, $ED_{50}$ could not be reliably calculated and is represented as "N.C." (not calculated).

TABLE 57

Reduction of human ATXN3 RNA in transgenic mice

| | | Spinal Cord | | Cortex | | Brain Stem | | Cerebellum | |
|---|---|---|---|---|---|---|---|---|---|
| Compound Number | Dose (µg) | hATXN3 Expression (% control) | $ED_{50}$ (µg) | hATXN3 Expression (% control) | $ED_{50}$ (µg) | hATXN3 Expression (% control) | $ED_{50}$ (µg) | hATXN3 Expression (% control) | $ED_{50}$ (µg) |
| 1100673 | 10 | 72 | 16.3 | 83 | 62.9 | 88 | 33.6 | 78 | N.C. |
| | 30 | 39 | | 76 | | 58 | | 76 | |
| | 100 | 23 | | 47 | | 34 | | 65 | |
| | 300 | 14 | | 15 | | 20 | | 50 | |
| | 700 | 12 | | 11 | | 17 | | 42 | |
| 1101657 | 10 | 71 | 25.3 | 93 | 69.9 | 91 | 79.4 | 94 | N.C. |
| | 30 | 57 | | 76 | | 81 | | 77 | |
| | 100 | 36 | | 45 | | 51 | | 77 | |
| | 300 | 19 | | 23 | | 28 | | 49 | |
| | 700 | 19 | | 17 | | 25 | | 44 | |
| 1102598 | 10 | 74 | 28.0 | 91 | 65.0 | 108 | 113.9 | 98 | N.C. |
| | 30 | 53 | | 63 | | 71 | | 69 | |
| | 100 | 41 | | 55 | | 60 | | 69 | |
| | 300 | 30 | | 24 | | 39 | | 59 | |
| | 700 | 23 | | 18 | | 32 | | 45 | |
| 1102811 | 10 | 76 | 24.7 | 90 | 80.4 | 93 | 49.5 | 92 | N.C. |
| | 30 | 47 | | 74 | | 67 | | 75 | |
| | 100 | 30 | | 51 | | 41 | | 66 | |

TABLE 57-continued

Reduction of human ATXN3 RNA in transgenic mice

| Compound Number | Dose (μg) | Spinal Cord | | Cortex | | Brain Stem | | Cerebellum | |
|---|---|---|---|---|---|---|---|---|---|
| | | hATXN3 Expression (% control) | $ED_{50}$ (μg) | hATXN3 Expression (% control) | $ED_{50}$ (μg) | hATXN3 Expression (% control) | $ED_{50}$ (μg) | hATXN3 Expression (% control) | $ED_{50}$ (μg) |
| | 300 | 17 | | 31 | | 25 | | 67 | |
| | 700 | 11 | | 16 | | 18 | | 62 | |

TABLE 58

Reduction of human ATXN3 RNA in transgenic mice

| Compound Number | Dose (ug) | Spinal Cord | | Cortex | | Brain Stem | |
|---|---|---|---|---|---|---|---|
| | | hATXN3 Expression (% control) | $ED_{50}$ (μg) | hATXN3 Expression (% control) | $ED_{50}$ (μg) | hATXN3 Expression (% control) | $ED_{50}$ (μg) |
| 1102130 | 10 | 69 | 21.0 | 76 | 28.6 | 78 | 33.2 |
| | 30 | 54 | | 51 | | 58 | |
| | 100 | 31 | | 37 | | 36 | |
| | 300 | 24 | | 14 | | 33 | |
| | 700 | 18 | | 9 | | 23 | |

Example 10: Effect of Modified Oligonucleotides Complementary to Human ATXN3 in Cynomolgus Monkeys Following Repeat-Dose Intrathecal Injection, 13-Week Study Cynomolgus monkeys are treated with modified oligonucleotides to determine the local and systemic tolerability and pharmacokinetics at 1 dose level, following 3 intrathecal lumbar bolus injections administered 4 weeks apart. Cynomolgus monkeys in groups of 4 are treated with either artificial CSF or modified oligonucleotide. Tissues are collected 1 week after the final injection.

Assessment of tolerability is based on clinical observations, body weights, food consumption, physical and neurological examinations including sensorimotor reflexes, cerebral reflexes and spinal reflexes, coagulation, hematology, clinical chemistry (blood and cerebral spinal fluid (CSF)), cell count, and anatomic pathology evaluations. Complete necropsies are performed with a recording of any macroscopic abnormality. Organ weights are taken and microscopic examinations are conducted. Blood was collected for complement analysis. In addition, blood, CSF, and tissues (at necropsy) are collected for toxicokinetic evaluations.

Activity of modified oligonucleotides is analyzed in brain and spinal cord tissue by measuring cynomolgus monkey ATXN3 RNA. Brain and spinal cord samples are collected and flash frozen in liquid nitrogen and stored frozen (−60° C. to −90° C.). At time of sampling, 2 mm biopsy punches are used to collect samples from frozen tissues for RNA analysis. Punches are taken from multiple brain and spinal cord regions.

Example 11. Human Clinical Trial with Modified Oligonucleotides Complementary to Human ATXN3

Ascending doses of modified oligonucleotide are evaluated in a randomized, double-blind study to evaluate the safety, tolerability, pharmacokinetics and pharmacodynamics, and clinical efficacy in patients with confirmed genetic mutation in SCA3. Patient safety will be monitored closely during the study. Safety and tolerability evaluations include: physical examination and standard neurological assessment, vital signs, ECG, AEs and concomitant medications, Columbia Suicide Severity Rating Scale (C-SSRS), CSF safety labs, plasma laboratory tests, urinalysis, and neuroimaging studies.

SEQUENCE LISTING (2806 sequences)

SEQ ID NO: 1 - DNA, 6923 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 2 - DNA, 54000 bp, Homo sapiens
attaattcatttgaaagacatcaactacaatttaaaaaaacaaaacaaaaacagaaaaggtggtttgcaatttttttcacttcatgagactataatttatttccctgggtaggccacacaaatccttaagaacatggactttcccccatacaaggctgtgaaccgtgcacacagagatgctcgataaatggtaccgaatcctctccttcagcacctggtcctctctggcagtctccattctcttacctctcactgccccctctacttctctgaacctgcagtccccaaagtcaccaatggtctccatagcaacaaaatttagtgggctcttatacgaccttatattgcttgacttcttggcagcaactgacactgactaccccttgaagcatcccctgcccaggccttccacaatgtcacactctcttgcttctcctccctcctccttggttattgcttctcctatcctcacggctcagctctagccctcttctcaatcacttccttttccctaaaatgattttattcactcctatggtttcagttacttttttttttttttttttttgagacacagtttcactctgttgtccaggctggagtgcaatagcacgatcttggctcactgcaacctctacctcccggttcaagtgattctcctgcctcagcctcctgagtagctgggattataggcatgagccaccacgcccggctaatttttgtatttttgtagagatgaggtttcaccatgttggccagcctggtcttgaactcctggcctcaagagatctgcctgcctcagcctcccaaagtgctgggattacaggcatgcaccaccacaatggccttagctatctgttttttaatgacaattcctcattgagttcaaagcagcctcctgaacttcagactcggtatccaaccattactcaacataattactcaaatgtccatagatatttcaaattcagtatctccaaaatgtaaactctatcttattctcttcccaaaaccttgctgctcctcccatgtttctgctctcaataccactcctgccacagtggctgcccaggtcacaaacccagaagtcaccttcacatttctgtctcctaccttccccaatccctcattgtggtaggagttattaagaaattattttaggcagatagagaggaaaaggggtccttgaaaagtttttgtctcttttgaagcagctcctgagacgtttcctgtctagcataaaagccctgacttttagacccgagctggcaacgtttgatatgcaaatgccggcagttagaaactgggtccaccaacacggtgattcccaccatcgtcctcttgcccttgttctcacaagtgcctggcaacatggccacccccacatatccccacatgagtagaacatcatagcgccctgcatttgcatattaaaaggctagggtggaatggccagttttattagggggctacatgaatgacatgcgtggtcaaaccagtcccctgagccctatgcaaatcagacaccgcctcctgcatcctcctcctataactggctggtatctcccacgcactctgggtctcctctctcagctttggagcacccatccctctgtctctgtacaggggagctgcttctttctttcttctcccttccttcttgcttattaaactctccgctccttaaaaccactccacgtttgtccatgtcgttttatgtaattcgactcaagacgaaaaaggctagtattcctccactcggtatcatcaccacattctgttgagtctctttacgtccaaagaatctctcaaaatgggctatttccatctttaagacactctcttaaaccaccatcgtctctcccaagattccttcaacagcaactgcttttttctgcagccagtgatctttctaaaaggcaaacatgaccacatgtcttcttttaaaatatttatatagctccccacatcctttaaaaggtacactttggccaggtgcggtggctcacgcctgtaattccaggactttgggaggccaaggcaggtggatcacctgaggctgggggttcgagaccagcctggccaacatggtacaacctcttctctactaagaatacaaaaatagttggacttcgtggtgcacgcctgtaatcccagctgtttgggaggctgaggcaagagaatcacttgaacccaggaagcagaagttgcagtgagcggggagattgtgccactgcactccagcctgggggacagagagagggccgtctcaaaaaaaaaaaaaaaaaaagtacaccttaatctggtttcaaggtgcaagatctgcacctatccttccatttaagtttcatcaaaccgctgctacctccccgtctcccacacaatttatgggacttctaagttccctctaaagggtccgaacacctacactggtaacaagccacctggatttgaatcctggcaagacaacttactatctgaccttggacattgtgctgttcttaacctctccgtgcctcggtttcctcatgtgtatgaataacatcaacacctacatcaaagtttgctgtattaaatttgataatatatgcaaagcatttagaaaagtgcctagctcatagaaagccttatgtaaatattaactatcattttttttcttttttggggtggtgggggaggggtttcgcttttgttgcccaggctggcgtgcaatggcacgatctcggctcaccacaacctcggcctcccgggttcaagcgattctcctgcctcagcctcccgagtacctgggattacaggcatgcaccaccacgcccgggtaattttgtatttttagtggagacggggtttctccatgttggtcaggctgatctcaaactcccgacctcaggtgatccgcccgcctcggcctcccaaagtgctgggattacaagcgtgaagcacctcgcccggcctagctatcatttttatacaagtgctgggttttgggagaatgtaatgatggcttttttcttactaaactttcagtgcaggaggaggagaaagaaagtaaatagttatatgaacacagtagaaagtcaaagtggaaaacaaaaagaacatagaacccaggtgagcggtccagacctccccccagaaacctaagaatccatagaaatgggtgggaagcggagaagatcctccagacagcaggtggcgatgtagcatcccccagaaggcccgctaacagaagctaggaggacgcgctaccaaggtcacgtgtccccggcgttcactcgctcttcgcttcacgacactcgcatcctcacgggtgattggtctgcgtgcggcacgtgggcggggtaccggggcgggccggggaggggcggggtgggcggaggagaggggcagggggcggagctggagggggtggttcggcgtgggggccgttggctccagacaaataaacatggagtccatcttccacgagaaagtgagtgtccgcgttcggtggggagctgtctgccgcgcggtggcgggcgtggagcgcggcatcaccgcctctcggagggctgggtggggcccgagtcgcccccatgccgatctcgcccggcgaggggcgacgccgcagcctcccgcctcctcggctcgaggaggggagcatcacctacgcccctacttcccccgcggcccccgccctgggagccgggagggagtatgggcggggccgggggcgtctcgggacacgggagtggggtggcgcccagtgggtttgcttctgcctttctccgtcactttccatcgcttttcggaggattccttcacccctccccaatccttccctctccctagggtctagctagagtcatctctgggacacctccctcaacccctcctaccctaatcctggcagaattaacttttcctcctccggactgctcaattctatattggagtcttccctacacgtagatctttggggtcttgttcgtgtctttcccctgcactaggtccgcgagcctcccgagggaggagaccttggctcgcccactgtagggcctgacatttaggaagtgaagtaggaaacccggcgtgcccctaaacagggaagtcgtcacaagagtttttattacgggatgtttgggtttggtttcttttggtactcccatctttccggagcaggcggccagctttgtttttaggtattaggagtggactgggatgattttgttgtagtctgcctagcctgctgtccctttaactcttccgtgaccatgcacttgaagatactgtttgtgatatgtaaagaaactcctcgtttctctcatactattatccagccatttgtgtgtgagtgaagccttccccaggacagctttggcacatggtatcatgtttcataatagtttcgtgtttggaaagagttgctggtaaggctgttatttaataggaggagcaaagggtttttgttttattaaatacttataaatgatcatttatcccagacatttaaaattcacacacacacaacaaataaagcaaagacaaaagaatacatttaccaaatgtaaatctgtagcataaattttttttaatttttattttaaagatggggtctcattctgtcacccaggcaggtgtgcaatggagagatcatggctcactgcagccttgatctcctaggcacaagcgatcctcccgcctctgcctccagagtagctgggactacaggtgcatatcgccagggccaggtaatgtttttgggagagacggggtctcgctgtgttgcccaggctggtctcgaactcctggactcaggtgattctcccacctcggcctctcgaagtgctgtgattacaggcgtgagccactgtgcctggaacaaattgttaagtacaatgcttttcattgtagaaaacatctcggaaacttttgaaataggctgatgttcagtgggggaggaaggactcagtcgtatagttgtcactaattttttgacttgattgacatgactcgtaaatcatagacaatagagatttggttgcttggctgagtagagtgcgtgaaaaatacacacgtacttttttttttttttttttgagatggagtttggctcttgtcacccaggctggagtgcaatggcgccatcatggctcactgcaacctccgcctccccgttcaagcgattctcctgcctcagtctccccagtagctgagattacaggcgcccgccaccacgcccagctaatttttgtatttttagtagagacagggtttcaccatgttggccaggctggtctccaactcctgacaggtggtccgcccgcctcggcctcccaaagtgctgggattacaggcgtgagccaccgcacccggccatatttttgttattaattttcaaaggctttggtgtgggaccacatttcaacatggaaggccttaaacatgttccacactacttcctgagaattagacaagatttttaacaatattgttacctagttgggacacatttgtactgacccatgggatgaaaaaaagctgagtgctagcctagtgaaaatctacttacccgaaagaaatccctcttagtctgggtgcagtggctcacaccagtgctttgggaggcccagacgggcggatcatgaggtcagtagtttgagaccagcctggccaacatggtgaaaccccgtctctactaaaaatacaaaaaattagccaggtgtggtggcaggcgcctgtaatcccaggtactctggaggctgaggcaggagaattgcttgaacccgagaggcagaggttgcagtgagccgagaccgtgccactgcacttcagcctgggcaacagagcgagactccgtctcaaaaaaaagaaaaggaaaaaagagtccctcttaattatcagcatgtgtataggcctacagatacttcaggaatacctttaccattatcatcaacttgtatctacatagcatgtgaagattcaacaatttagttttttgggcgtcctcaagagtacgcacctataaccatatggcccaattgttaatctcctatacagtccattctgggaatgtttgggcttactgtgccatttttccgttcactgccttcccctctgcaatatacctttaacccttgctaggtcctgggtttggagagccagagaaccaactttggccctaaagaagctgtgtaggtagcaatatctgcctacgaagggccttgcaaccatttcctcttggaaccttggtttcctctttctgagtagtcactttgagtaccctttattaagttagaatgtaaaaacagtttctcactgatatatctgcagtgcctgagagagggcctggcacagagtaagtactcaataaatatttgaatggggccgggcgtggtgagacctgtctctacaagaatgaacaaaattagctgggcgtgttagcacatgcctgtagacttgggaggctgaggtgggaggattgcatgagtctgggaggtcgaggctgtagtgagccatgatcgcaccactgcactccagcctaggggacagagcaagatcctgtctcaaaagaaaaaaatgtatatatttgaatggataaagagatggctttgagtttctgagatatatatggtgctgtttatctaaagtaaacaagttttctgtaaatattttaaggctttgcaggccagctgtagtctctgtcacacattcttatttgtgcatgtttttcccaaccatgtaaaaatgtaaagtgcattcttagctactggggcaggttgaatttggcccatgggctagagtttgccaacccctaacttaaacctttgtactaactttatgaccactactggatttttgttgttgtttgttttagttctggtgcctgctttgtttttttttttttttttaatcctcttgctgatgtttcttggtgcagttactgtgccatttgtattggtgcttttaatgtaatgcaaactggtaataatatctaaacttgctggggttgtacataaaattattgaaaagattgaaaagatgctgagcattgactctgtggcattcattatgcccttttgtgattgctggattttagccatctttaggacatttgagctttaggagaagccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgaggcagagtctcactctgtcacccaggctggagtgcagtggtgcaatctcagctcactgcaacctccgcctcctgggttcaggtgattctcctgccttagcctcctgagcacctgggactacaggcgcctgccaccacacctggctaattcttatatttttagtagaggcggggtttcaccatgttggccaggctggtctcgaactcctgatctcaagtgatcaacctgccttggcctcccaaagtgctggaattacagccatgagccaccatgcccagccaaatcatgagatttcaataccgctgaactttgattatggcaaagtgaacttctgctttgattaaagcttgatgagagaggtggctggggatagtttgagataagggcaaggcaggaaaatgcataatcttacgtgggctcattgtcattgtacaattcttttggtccatgtggaatttgatccgtcctatgacttaagttatgtttatttttgtttttatttttatttattttgtgtctttttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtcctttccttccattaaatcatattagaagtacagaacttgatatttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccgtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcacgaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgtatatactaaaaatacaaaaattagccaggcatggtggtgcatgcctgtagtcccagctacttgagaggctgaggcaggagaatcacttgaacccgggaggcggaggttgtggtaagctgagattgctccactgcactccagcctggacaacagagcaagactctgtctcaaaaaaaaaaaaaattaatgattaaattatttaggggagccgggcgcagtggctcacgcctgtaatcccagcactttgggaggccaaggcgggcggatcacgaggtcaggagatcaagaccatcctggctaacacaggatgaaaccccgtctctactaaaaatacaaaaatttagccgggcgtggtggcgggtgcctgtagtaccagctactcgggaggctgaggcaggagaatggcatgaacccgggtggcggagcttgcagtgagccaagatagcgccactgcactccggcctgggtgaaagagtgagactccgtctcaaaaaaaaaaaaaaattatttaggggaagatactatacaattctgtttaacaagtcacattttaattttttcttttggaaatattagcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggtactgattttaaactcactaagtcacatttcttttttttttttttttttgagacggagtctcgccctgttgcccatgctggagtgcaatggcgcgatctcggctcactgcaacctctgcctcccgggttcaagcgattctcctgcctcagcctcccaagtagctgggattacaggcacacggcactatgcccggctaattttttgtatctttgttagagatggggtttcaccatgttggtcaggttggtctcaaactcctgaccttatgatccacctgtcttggcctcccaaagtgctgggattataggtgtgagccaccacacccggcttacatttcttttaaaaatgtggataccatttagaaaaggatgggccattcttcctatagggatctgactggtgaattataactgtgctgttaactttggaaatgggaatgcacaagatattgttttaaatatgcacgctaatgacagtttgtatccttctttccccacccccacccttgcttcaactacctgtcaaaattaacagcagccttctggaaatatggatgacagtggttttttctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggccgggcgcggtggctcacacctgtaatcccagcactttggggaggccgaggtgggcggatcacgaggtcaggagattgagaccatcctggctaacatggtgaaaccccgtctctactaaaaatacaaaaattagctggacgtggtgacacgtgcctgtaatcccagctactcgggaggctgaggcaggagaatcgcttgaaccagggagtcgtaggttgcagtgagccaagatcgcgccactgcactctagcctggtgacagagcgagactccatctcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtatagctctctttgaattctttggtggttatatatatatgtactcgcaagattcttttatctgtgggtctttcattctttttctaacactgtgagttgtatccagagtactttcggaacctctcctgagcgacctatctctgcagatatctttgtttatgtttcccttgtactgccctcctggactcttcctcatccaccagcatttccatctagtgctttaccgtgccactgctaacaggtaatggctactgcagggctgaaatcagaggccagagtaggcccagcacttggcgtttcctatttgtgccttgctgctcttggtgcctgttcatgtgtgcccactaccttgcactcaatttctgtctttgctggtacctggctcacttgcttctttgttggctaccttggagggcagatagtgaattttcagaaatttccctttttttgtcagacagattgaaataaacaggtttgcattttgttttttctacaagcggcaagcccatgaccctagaagtctgacatctatggaaccttcagtttaaatgcccagggagaacttattttggtagatatgatttctgacattgcaggtagcaagttgaatataatttttctaaagtagcacccacagcagccaaattatcagatgtatatagtagactagttttaagaaaagcacttatgggtagaatatacatctggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggcccaggcgggtggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcggaggttgcagcgagccgagatcgtgccactatactccagcctgggcgacagagcaagactctgtcacaaaaaaaaaaaaaaaaacctatagccttctagagaaatttatatatgaagtacacaactaacatagctacacttcctaaatttggaatggagtggtttagcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatacattttgaatacttttgttttgatgttccctgtttcattcactcagactttcctatttcacctttgtgatgtccatgagcatctgccctgtagccttcctggcaccccagtgtctgtggcagcacagagctgaccccataagtggtgcatgaggccatcttgtggcacagcatcactaagctgctgcagagacgttcatatggttgtgtgatcttttaaaaacatcagtgacacttaactataaatataatcttaaattatcacaaattttatataatatttgccagtagacaacataaatatgaattcaatatttcaagttaatattgtctgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaagtatatgcaatttaactatatcataagaaaaattctatattaaagataatacaaatgtggttacttttaagtgggtttttatgtgatgactatgttctgtcagttaattattacatttatagatttgtatttagcatagtgctgtcacaaagcctgaaatagtgtcaagcatgaataaagcattcaattatgtttgctttagtgtaagattattcattatgattccaaaagccatgtaatacgtacgtctacagaaaatcacttctattttttaaataaaacatgaaatatgtcttgagcaagctattttaagaaacaatcatttaacgtccttgttattagaattttgaatctttgaaagagggttattgaaaaccagctaggacagtaaaaaagaataaactagtgatacatgcagcaatatggatgaatctcaaaataattatgctgaaagaataacccacaaacaaaatactacctgctgtatggtatcatttattaaaagtctagaaaagtgcagattcatctgtagtgatggaaagcagattgaccagcggttgcctggggacgagaaggctatggaggagtgagaggggagggttacagagaggcacgggaaacatggcaatgaggaatgtgttcactatcttggttgtagtaatggtttcatgggagtacagtatacaaatgtgaaaacatttcagaggccagatgcagtggctcatgcctgtaatcccagcacttttggaggccaaggcaggaggattgcttgagctcaaggagttcaggaccagcctgggcaatggcacaagaccccatctctaaaaaaaaaatgaaagaaaaaaaaattggctaggcgtggtgatgcatggccgtagtcccaggtgctagggaggctgaggagggagcacagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttaaaatgtaaatacaagccaaaaaaggtataagtcaagaaaatatattgaattaaatctgtaagagataattcaaaaacaaaaaccctattgttatcttttaagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcttgtctcagcctcccaaatagctgtgtctacagccacgcaccaccacacccagctaatttttgtatttttagtagagacggggtttcgccatgttggtcaggctggtcttgaactcctgacctcaggtgatccgtccgtctctgcctctcaaagtgctggggttacaggcgtgagccaccatgccgagccctaagttggttctttcttaaagttcttcctgaggagccaagagcaagttaaggagatgtaacctagaagcttacagtggaggctagctgggtgcagtggttcacgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttagcagaggccaggtgcagtggctcatgtttgtaatcccagaactttgggaggctgaggcgggcggatcatttgaggtcaggagtttgagaccagcctggccaatgtggcaaatgtgctgtctctaactaaaaatacaaaaattagctgggtgtggtggtgcagacctgtagtcccagctacttgggaggctgaggcaggagaatcacttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctataatatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttctaggccactgttcttccttataaactccagtttctttgaaatacatgcccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccgagctactcgggaggctgaggcaggagaatggcgtgaacccaggaggcggagcttgcagtgagctgagatcgcgccactgccctccagcctgggcgacagagcgagactccgtctcaaaaaaaaaaagaaaagaaaaaaaaaagaaatacatgcccctagattaaactatcccttgtccttttgcactcatccacaagtctcttttcatcagtgattttaggatctgactcgttgtctttttctctacttcaactacttttatcattcttaattatttctgtatcgtcaatcaatccagtacctgcctcttagtttcaaaatcacttactcttgcttagctattaccagtaatcataaccactgtcaaatctcaattgcaagcatattactctttaactaccacctcctatctttaaaccatgttttgtctgtttttttattccagccattctttaaaccctactgtggggcccaagcatttcctttatacgcattcttcctttcttctactgcttattttctgtaatccgtcatcataatcactccattgcattcttcaacgtgtttcccctctctccctccatcatacttgaatgacaaaaatctcaaccctggttaaaccacatcttggccttgtccattcctgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgccttagcctgttgagtagctgggactacaggcttgtgctaccacacctagctaaggttttactttaaatttattataatcacaaaattcagatgagcctttagtgctgtctgatatttctactatgttttcttagtgatgtaccaccctccaaggtgtttataaaaaattatgtaccactctccaagaagtttataaaaaataatgtgccaccctccaaggtgactaatttcacagcttatgtctttaaacctttaagcactttcctctcccttacacaccttccttgtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcacctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctcagcctcccgagtagctggatttacaggcatgtgccaccatgcctggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatattggccaggttggtctcgaattcctggcctcgagtgatccacctgcctcagcctcccaaagtgctgggattacaggcgtgagtcaccttgcctagccatcttttagtaatggtatttggagatcacaatttgagtgctggcatgcttattgctgctgggtttgttatgtagttattgtgaattcacatttaggaatatagggtttttaattctttgattttagatacttgtatcttttttcttttatatttaaaaccttggttcctgatgatatcccttcttagaaaccctgtctacctttggccttcagcccaccatgctgtggttttcctaacttgctgcctgcacttttcagattcctttcatggatcttaaatatcatctgtaaataagatctatgtgtcaataattaccaaacttttatctttagtcttgacatctaccctgaacacctagctttgactaactcctagctttggcatctccacttggaaatccaaaaagtgtttcaaactgaacatgtctatgaaagacttatttttttctctctatccatgctatccatcaggttttccatttccataagggtgactcttgtactctggttcctatatattataccgacagagcagcccagagtgcttcttaaccagtgtaaggcctgttatgtcccaccctcactctttgtccttcagtggcttcccagcacacttagaataaaatctgaagtcttaggccgggcttggtggctcatgcctgcaatcccagcactttgggaggatgagggggcagatcacttgaggtcaggagttgatgagaccagcctggccaacatggtgaaaccctgtctctaccaaaaaatacaaaaattaactgggtgtggtgttgtgcacctgtagtcccagctactcgggaggctgagataggagaatcacttgaacccgggaggcagaggttacagcgagccaagatcataccactgcactccagcctgggtgacagaacgagactctcaaaaaaaaattaaaaaaaaaaaatatgtgaagtcttgaataaaacccaagatctttaccatggcccctgaacagggcagagtatccattcttcagacactcttcatagaataccatggtgagctggcatatttattatacaatacagaaacaattttactggcagaaaacacattaaaccgtctaaactctgaatacagttgtcctcataaaaaatgttcaacatactattttgaggttttccattaatagttcttataatctttgtcccattatgtgttaatccaacaaaggatatccaataacaaacaccaaagtttaagaaaaatgtgctaggcgcggtggctcacacctgtaatcccagcactttgggaggccgaggtgggcagatcacctgaggtcaggagttcgagaccagcccagccaacatggtgaaaccctgcctctcctaaaaatacaaacattaactgggtgtggtggtgggtgcctgtaatcccagctactcaggaggctgaggcaggagaatcgcttgaacctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctggaatcatatttagacacagtcacactagactaatgtaattcttttgggatgcaaaccacacgtttgacaccttaaatagcttttaggtatttggcttcccagcccctatttttagttacaaggggtgtacatgtgtgggtcagggtgggggtagctctttccgcagatgattagttttagccatgttactagttattgcacacattatctgtgtcctcacagcagccctgtgagtaagtgtattagggttctctagagggacagaactaataaggtagatgtatatatgaagggtaatgtattaaggagtatcgactcgtatgatcacaaggtgaagtcccacaataggctctctgcaggctgaggaaccaggaagccagtccaagtcccaaaacctcaaaagtagggaagctgacagtgcagccttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacaccctcgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactatattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactggttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacttaaagcctttacattacaaatgcctttatgttatgtctaaaatagaagattggttgcagttattaccagtgcttttgttctttagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctatattttattaggagtagttatatttttactcctggttattttatttggtttcaacactgtactaacacaatagtaaattgtggttttaatctttgtgggtatcagttgacccttatccaaatcagctgttacataaatatgtgccattagacactatggaagggcctggacagggaatataaactgattttacaaaaacccaacatttattggctatgcaacttaaaccgtaagcccactttggtgggcccagttttttagtgatataaactatcaatagagaaaagcgaaaacatatcccctagacaatctaggcaaagaaaaatgttaagacatagctcaaagtagcttaattaaaagtttgaagtgggttttttgttttatttttttctaactcatatgtatttgcttctactttctaatgaaattatttatcagttgatttccttagatatctaaataaaattgaaatttcattaatgggaagattatttttatcctgaacttttcttgcctctatgcatgcctctgagtactccatatggtgtgcaatcccatttttgattaatagagtcctgctggattagcagggacagaaatcagctttagatttctttcttttttttttttctttctttttttttttttttttttttgagtcagagtctcactgtcgcccagcctggagtgcagtgatcttggctcactgcaacccctgcctccgaggttcaagcgattctcctgcctcagcctcctgagtagctgggactacaggcgcctaccaccacgcccagctaattttttgtacttttagtagagatagggttttgcccttttggccaggctggtcttgaactcctgacctcaggtgatccacctgccttggcctcccaaagtgctgggattacatgtgtgagccaccacgcccagccagaagagtagaatattcttaaagagaaaacgttttaaaggcttactcaaatgagtataaacaaacatattgttgcttgaattggtaaatacagtgattggtttttgttgtgttgtgttttgttttcaggtagttccagaaacatatctcaagatatgacacagacatcaggtacaaatcttacttcagaagagcttcggaagagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggacgggcacggtggcttacgcctgtgatgctagcagtttgggaggccaaggcgggcagattgcctgaggtcaggagttcgagaccagcctgggcaacacagtgaaaccccatctctactaaaaatacaaaagaatcagctgggcatggaagcgtgcgcctgtagtcccagctgcttgggaggctgagccaggagaattgcttgaacccgggacgtggaggttgcagtgagccgagatcgcaccactgccctccagactgggtgacagagtgagactccgtctccaaaaatatatgtatatatatataaataaaaataaaaatttacggcaaataacatgaaacaaaaaaaccttgccccaatactggataaattttttaaactgagtgaaggaaaccttataaaatttcatttattaaaagaaaaatgaaattaggacaagacaagaagaatgccaattgatcctttggatgtacttcttgcttacctgattaaccctgcaaaattcctctaccaatcagtacgaaaaacagctttggaggtatgggagcgcattcccaaatagacgtggtagttcatttagctgctcatggccgcttcaggcagtcctgtaagcctgttagcatcaggggaatggatgcaaaccataaatctggatcaactcctaaaaccttaccttgtgcccagccttgtaagtgcttgctaaataggaattccaccatatgaaaatacattcttttcaagtaactatcattcagacttttgtcccccactttttttttttaaagaaaaataaaaggctgggcacggtggcttacgtctgtaatcccaccattttaggaggccaaggcaggtggatcacctgaggtcaggaattcaagaccagcctgaccaacatggtgaaacctcatctctactaaaaatacaaaaattagccgggcatggtggtgggtgcctgtaatcccagctacttgggaggctcagacaggagaatcgcttgaatctgggaggcagaagttgcagtgagctgagataacgccattgcactccagcctgggggacaagagcgagacttcgtctcaaaaaaaaagagaaagaaaacttcatgttaaagattacaagataaataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaacctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcagatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcacttgaacccgggaggcgaggttgcggtgagccgagatcgtgccattgcactctagcctgggcaaaaagagtgaaactccatctcaaataaataaataaataaataataaaaaataacttaaatctacttaattagaaaaactaacattctaaaaattttattttaagaaatatcaaaattggctgggcacggtggctcacgcctctaatccctgcactttggaaggctgaggtgggcggatcacctgaggtcaggagggtcaggagtacaagaccagcctggccaacatggcgaaaccctgtctccactaaaaatacaaaaattagccaggcatgatgatgggcacctgtaatcccagctactcaggaggctgagacagaagaatcgcttgaacccaggaggtagaggttgcagtgagctgagatcaccccactgcactccagcctgggtgacagagtgaaactccgcctcaaaaaaaaaaaaaagagaaaagaaatatagaaattaaagcatacatggccaggcgtagtggctcatgtctgtaatcccagcactttgggaggctgaggcaggcagatcacttgaggccatgagttcaagaccaacctggccaacatggcgaaagcctgtctctactaaaaatacaaaaaaattagttgggcatggtggtgcacacctgtaatcacagctactttggaggctgaggcaggagaatcgtttgaacccagaggtggaggttgcagtgagccgagattgtgccactgcactctatcctgggtgacagagcgagatactgtctcaaaaagaaaaaaaaaaggctgggcgcggtagttcatgcctgcaatcccagcactttgggaggccgaggcaggcagattacgaagtcaggagatggagaccatcctggctaatacagtgaaaccccgtctctactaaaaaatacacaaaaattagctgggtgtggtggcaggcacctgtagtcccagctactctggaggctgaggcaggagaatggcatgaacccgggaggtggagcttgcagtgagcagagatcacaccactgcactccagtctgggcgacagagcgaggctctgtctcaaaaaaaaaaaagaaagcatactctcacctccttcagtgactgatgttagtattttggcacattctttttctgtgacatatacacacttaccttgtaagtgttgtactcatttcctatgacagtaaatagtctttgtaacaggctgcatgatatttcataaaatgaatggatgtggcataatttatatgtgagccttttgaattctgctattataattaatattgcaatgaacaattcttatattgcctctacacctcaaatgtcttatcatttcttctagtttttctgaggatgtcagattattgggttaaaggatatgaacatttttaaggccttggaacagatttctaaattgctttccagaataattcccatgtgatactttcaccatgtttatttcagacttttttttttttttttttttgagacgaaatctcactctgtcacccaggctggagtgtagtggcatgatctcggctcactgcaacctccgcctcctgagtttaagcgattattctgcctcagcctcccaagtagctgcggttacaggcaagtgcctccatgcctggctaatttttgtgtcttttgtagacatggggtttcaccatgttgcccaggctggtttcgaactcctgagctcaggcaatctgcctacctcggcctcccaaagttctgggattacaggcgtgcaccaccgcgcccagccatcagagtcttttttgtcaaaataaaatggtctaaagacatacatcatagagaaactataatacaaaatttacaggtatatctaagaaaagaaaagtatatttaaagcataaaaataaactgctcttttacttaaaattttttaaaaactggattaaaaatatgaaacttccaacaaattgagcttttttttttttttttttcttttttgagacgaggtctcgcttttgtcacccagtctggagtgcagtggcgcgatctcggctcactgcaacctccacctccctggttcaagcaattcccctgcctcagcctcccaagtagctgggattacaggcgcatgccaccacgtcgggctaatttttttgtatttttagtagagagggggtttcaccatgttggccagactggtctcgaactcctgatctcaggcaatctgccagcctgggtctcccaacatgctgggattacaggcatgagccactgcactcggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctactacatcagctgtgtcactgtaaaacctgccttaactcacagaagcatgaaattaagcaatgtgtgtgaaactattttataaactgtaaagtattccatacatacatgttggcagttattaatgtcttctctaggtgtggctttgaaatggatgcagatgctttctgttacaaaaaacataagttgcaaatgttctataacaaggagagacacaaatatcttcatggacatggattgctatgagtgtttgattgcctaatacttgagccaccacttcagtgatatggtataatttatcaaacagtgttgagaaacagaaactactggggatgttttaaagaggaaaatacttaatatagaaattaggggtttacataatcttaagaaaggatgaaggtgcagctcttagccaggcctccacagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtgaagcagaattttgggactggcatctcccaaatggctttgcttgccaccagagaacaaccaaagtggagggagatggctaggcctcatttctgcctattttattttattttttgagacggagtcttgtctgtcgcccaggctggagtgcagtagtgtgatctcggctcactgcagcctccgcctcccagcttcaaacaattctcctgcctcagcctcctgagtagctgggattacaggcacccgccactgtgcccagccaattttcttatttttagtagaggtggggttttgccacgttggccaggctggtcttgaactcctgacctcaggtgatctgcccgcctcagcctcccaaagtgttgtgattacaggtatgagccaccatgcctggcccatttctcccttttttttttttttttttttttgaggtggagtctcactctgttgcccagactggagtgcagtggtgcaatcttggcgcattgcaacctctgcctcccagtttcaagcaattcttctgcttcagcctcctgagtagctgggactacaggtgtgtagcaccacacctggctaatttttgtttttgttttgttttttttgagacagagtctcactctgtcacccaggctggagtgtagtggcatgatctgggctcactacaacctccgcctcccgggttcaagcaattctcctgcctcagcctccagagtagctgggattacaggtgtgcgccaacacacctggctaatttttttgtatttttaatagagatggggtttcaccatgttggccaggctggtctcgaactcctgacctcgtgatccgcccgcctcggcctcccaaagtgctgggattacaggcatgagccaccgtgcccagacaaggtttgtatttttagtagagacagttttgccatgttggccaggctggtcttgaactcctcacctcaggtgatccgcctgccttggcctcccaaagtgctgggattacaggcgcaagccactgtgcctgacccgtttctgctttttaaagctcatgtgagcacttaatttgtaaccagaatcctacttgtaaaataatctaagacatgtagcttttagctttgtaacctctataatattgatggcacagtgggagtggatgctgagtaccacttgaacatgttccacctcagtgtcttcacagctggaaggtgtctacattgtttcaaggtggacaattgatttacttctcatttttcataaactaaaagtagaataaaggctattcctctaaaattgctatctcacctgtcactcccttgcattctcacataccttcttgagtggaggggcagagggcatggagtgatagcagatgtgccaggaattctccataactcagtccgtccctcttgtgctatgttgcagcatcaggatttgctaatgggaggatactgcccttacgtgcatcattagccatgcacactaaggtcttacacctacacacaggtcagtattctggctcagagaccaacagggagaaattgcagttctcattagttgaactttctttattgttcacagttttaaaacacaaaattgagaggaactctataaaaaatgtgccattctattaataattgttgctggtaatttaaaaatccttgttccttttcaaattcttatataccttttttttttaaacacttgatcttagccaaaagaccgagaagcaatcttttttttttttttttttttttttaacctatagcttctcactgagattgtcagctgtttgtaagttttggtttttggttttctgtgtttgtatttacatatatgaaatacagattgagtatcccttatccaaaatgcttaagactggaagtgttttagatttggggttttttaggatttgtgaatatttgcactatacttaccagttaagcattccaaatccaaaatttcaaatctgaagtgttccactgagcacctcttttgagtatcatgttggtgctcaaaaagtttctgattttggagcatttggatttctgattctcggatttaggatgcttgacctgtaatttcagatttacataaaagcagaaatagtacacagagctccttatatccttcacccagattccccaattattggcctttctgaaccatttgggaataatatgcagatatgattttccattatgtctcagttgttcagtgtatattttctaagtacaagaatatattcctacatatttacatgataaccgtcatgtttaaacattttaaaatggggatttgtattacattgtttctctttttgaaaaaattacagaggagcttaatgcaatcagtattacttaaaatctgataatgtgtgttaaatagtagttttcatttatttcatttatcaggtgttcagtgaatgcttactatgtaacagcacagttatcagcactggggaaatagatgagtaagataagatttgcactttcattagcttacatgccataaagagggaaataaagagaacaccagatgatgataagtttatgctgagaattaaaatgaagtgatgaaataatgggaatgtcaggtggctacttttggtgggatggtcaggaaaggcatctctggggagataaattttaagctcagacctgagtgaaaagaatgagccagccatggaaacattatgttaactcacatggtagtttgaaatgctttatctgatcaaaggtacttatttttggtgactttcaacaatattaagggtctataaaccaacactcatttgcataagaataactaccagtgaatctttttgtatgataggttttttgtttgttgtttttttgagacagagtctcgctctgtcgcccaggctggagtgcagtggcgcgatcttggctcactgcaacctctacctccccggttcaagtgattctcctgcctcagcctcccaaagtagctgggattacaggtgcctgccaccacgcctggctaatttttgtatttttagtagagatggggtttcaccgtgttgtccaggctcgtgtcaaacttctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaaaaattccttagacatcatggatatttttctttttttgagatggagtcttgctctgtcacccaggctggagtgcagtgtcgcgatctcggctcactgcaagctctgcttcctgggttcatggcattctcctgcctcagcctcctgagtagctgggactacaggcgcccgccacatcgcctggctaattttttgtatttttagtagagacagggtttcaccatgttagccaggatggtctcaatctcctgacctcatgatccgcccgcctcggcctcccaaagtgctgggattacaggcgtgagccatcacgtccggccagaaatcatgaatattagtaggtgaaaaataaacacattttaccacctggaaaatgaaaaatacttgagtataatctaaataacaatgggaagtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacccgggaggcggagattgcagtgagccaagattgtgccattgaactccagcctgggtgacaagaccaaaactccttctcaaaaaaaaaaaagattatagcatctttattcatcattgcccaaaattacaaactgcctaaatgtagaccttcatttagttaatgaatgcacaaactgtggtatatccaaacaattgaataaaaaaaggaatgaactggtacttttttctattcctcctgtttaagtacagccaaaacacctcaacatttgtataaaacatgagctgggctgggtgcggtggctcacacgtgtaatcccagcactttgggaggctgaggcgggtggatcacctaaggttgggagttcaagaccggtctgaccaacatggagaaaccctgtctcaactaaaaatacaagattagtcgggcatggtggcgcatgcctgtaatcccagcttcttgggaggctgaggcaggagaattgcttgatcccgggaagcgaaggttgcagtaagctgagattgcaccattgcactccagcctgggcaacaagagcaaaactctgtctcaaaaagaaaaaaaaaaccattcagctgaatctcaaaggcagagagaagacagactggctagggaccttggaaccagaggagcagtgtggtggggagtggactggattttctttttgcctcatttatcctggacttggtgctggagaagctatgggttcagaccaagagaaaaccccatgaaaagcctgctctctctagccaaaagaggcaacctagcaagataaaaacctttagataataagcacttgactccagtcaaacaaaacagaataaactggccccattcacccctgtcagcaaaggccaagtgggagccaagatatgtaccccaacctggaagtcataaggtacacttctcccctttcccagccaaggtggtgttagagaaggctgactggggagctgggattctcattccctccaggaggtgataacactcctttcacatggtgtcagtggtcacagggaggctgaacttccacccagtaatacataggcatctctctggctcctatatgggtgatgttggagaagaggccgagtagagaatccagactgttgctgacacccagcagtaacaaggacacctccacaatgtccgtggaggccatgtggagatcagtaacaaggcactgctctccctcccagtcagagagatgtcagtggaggactagggggctagaactcccatgtgcgttcagcagtaatccccatgaccgccactccttgacatcacaggccttgaagaaacctggactttcactcccctctggttgtagcgaggtggcactcccttttccctgttgccagtgctgtgtcagtggaggcttgctaaattggaagatgtaaataagattcacattctcataacataataccccaaattttcaggatttaattgaaaatcactaagctgggcatggtggctcacacctgtaatcccagcactttgggaggccaaggtgggccaaacacttaaggtcaggaattcaagaccagcctggccagcatggtgaaaccctgtctctactaaaaatacaaaaattagctgggcgtggtggcacatgcctgtaatcccagctactgggaaggctaaggcaggaaaatcactggaacctgggagacggaggttgcagtgatccaagatcgcactagtgtactgcagcctgggcaacagagcaagactccatctaaatttgtgtcaggattcccagaaggagatgagaaagggtggggctgaaaaaaattgaggaagaagtcatggctgaaaatttcccaaatttggcaaaagtcagaaacctacagattgaaaaagctgaatgaagctcaaatatgataaactcaaagaagttcacacagagacacatcacagtcagatttctgaacactgcagacaaaaaatgaagatctcgaaattagcaagaaatgaccttacctaagcaatttgaatgacagcagatttcccatcagagatcataaaggccagaaggaaggggtacatacaacattttttctagtgctgaaagacaaaaactctaggctgggcacggtggcacacacctgtaatcccagcacttttggaggctgaggcaggcagatcacctgaagtcaggagttcgagaccagcctggccaacatggggaaaccctgtctctactaaaaatacaaaaattagccaggtgtggtggcacgcacctataatcctagctacttgggaggctgaggcaggggaatcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaagctcatgccactgtactccagcctgggtgacagagcgagaccttgtctcaaaaaaaaaaaaaaaaaaaaaaaacaagaaaaaaactctaaacccagagttacatatccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacataccctgaccatatgacatagcatctatactcctgggcatttatcccagagaaacagaaatttatttattttttttttagtattacactccgtaagtgctgtaatactagcacttagggaggctgaggcaagcagattgcttgagcccaggagttcaagaccagcctgggcaatgctgcacagtcaaaaaagaaaaacaaacatttagaaaactattttaaaagtctttaattgctgaatgcctctttggctaatatttggaagatcattattattatttttcttttttaggcagagtcttgctctgtcactgaggctggagtgcagtggcgccatctcggcttactgcaacctctgcctcccgggttcacgccattctcctgcctcagcctcccgagtagctgggactacaggcgtgtgccaccatgcccggctaattttttgtgtttttagtagagatggggtttcactatgttagtcaggatggtctccatctcctaacctcgtgatccgcccacctcggcttcccaaaatgctgggattacaggcgtgagccactgtgcccagcctggaagatcattatttagtcctacaactgacacattgttccactgacgcaattgcccaggctggtcttgaactcctgggctcaagcaatctgcctgcctcggcctccctaagtgctagtattacaggcttgagccactgtgcccagccaaaaatagaaatttatattctcacaaaaacatgtacatgaatgtttatagcagctttacttgtcataatcaaaaactggaaacaaccaaaatgtcctacagtgaaacaaactgtagtacatccatagcatgtaatactctactgtcaggattaaaaagaaacccactgttggcacaggcagcaccgtggctggatctcaggggcattatgctgagtgcaaaaaagcctcaaagggtcttacactgtatgattccacttgttcaactaaaaatgacagctgtatagagatagagaacatattagtggtttccactagttagagaaagtgggtaaaagataggtgggtgggaatataaatcgatagcagggagatctttgtggtattataacacttctatgtcttgattgtagtggtggtggttacatgaatacacgtgtgataaaatgccatgtagaactacatataacgttgtgccaatgtcaatatctaggttttagtttgatctttagttacataagatgtaactattgggtgaaattgggcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaattaggattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattctcctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaatgcctctgatatttccctactcccttttataagaaaacccttaatcctaagggttgcagagggatgaagatccatcttctgtattcttcaggctgaataggggtgatgatattcctgcctatgagagtctcttgtattagggtagagaggagctcagtcagtcagtatggctccctatccttcctcccttccccagcccctgacaactaccattctactttgtctctatgattctaagtatctcctataagtggaatcattcagtatttgtagggtttttttgtgactagtgtatttcacttagcatgtcaaggttcatccatgttgtagcatacgtccaaattttcttctttttaaaaactgaataatattccattgtatgatatatgcacattttgcttattcatttatccatcaaagaaaaccagtagcttttttacataccggcagtaacctggttaaaaaaataagatggaaaataccaagcccgaaaatgtcaaattcttgaataccagacaggtactataatccaagctgagcagagaggaatggcccttgtctcagccctgagccacatgtcactacatgggccccaaggagctcttgtgcccagagtcctgctaaggctcgttcttcacccctctaaagtggctcaaactagcgtaggaggccaggagggagcagattctatgccacctccattgcttccgtgccttctccagatccattttttccaaaagctgtgtttgaattctgcacaggggcatctctgtctccaacactgaaacccc

SEQ ID NO: 3 - DNA, 6713 bp, Homo sapiens
gagaggggcagggggcggagctggagggggtggttcggcgtgggggccgttggctccagacaaataaacatggagtccatcttccacgagaaagttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 4 - DNA, 6770 bp, Homo sapiens
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 5 - DNA, 26812 bp, Homo sapiens
ggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaattaggattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattctcctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaatgcctctgatatttccctactcccttttataagaaaacccttaatcctaagggttgcagagggatgaagatccatcttctgtattcttcaggctgaataggggtgatgatattcctgcctatgagagtctcttgtattagggtagagaggagctcagtcagtcagtatggctccctatccttcctcccttccccagcccctgacaactaccattctactttgtctctatgattctaagtatctcctataagtggaatcattcagtatttgtagggtttttttgtgactagtgtatttcacttagcatgtcaaggttcatccatgttgtagcatacgtccaaattttcttctttttaaaaactgaataatattccattgtatgatatatgcacattttgcttattcatttatccatcaaagaaaaccagtagcttttttacataccggcagtaacctggttaaaaaaataagatggaaaataccaagcccgaaaatgtcaaattcttgaataccagacaggtactataatccaagctgagcagagaggaatggcccttgtctcagccctgagccacatgtcactacatgggccccaaggagctcttgtgcccagagtcctgctaaggctcgttcttcacccctctaaagtggctcaaactagcgtaggaggccaggagggagcagattctatgccacctccattgcttccgtgccttctccagatccattttttccaaaagctgtgtttgaattctgcacaggggcatctctgtctccaacactgaaaccccttttgccagacccagagaagatttaactgcctttttttttgagacagggcctcgttctgtcacctaagctggagtgcagtggcacgatcttggctcacggcaacctctgcctcctgggctcaagcaattctcctgcctcagccacccgaatagctgggattataggcgcaggccaccacatccagctaagttttgtatttttagtagagacgcagttttgccatgttgcccaggctggtctagaacttctgagctcaggtgatccacccgcctcggcctcccaaagttctgggatgacaggcatgagccacctaacctggccagatttaactgctttgagccaccgtctcacacatcttccaggagcttctagtcaaatgcagaggattaatagtgtataattccatttacataagatctttggaatagtcaaactcatagagacagaaagtagaatggtggttgccgggggatggttgaggggaaaattaggagttgtttaacgagtatggagtttcagtttgggaagatgaaaaaagttctggagatggacagttgtaatggctgcacaacaacgtgaatgtacttaatgccggtgaaccgtataaccatttaacaactgaaaatggttacaaaattttgtgttatatatatcttatcacaataaaaaatatagaggattgatcactatatttgctcccttccaaaatctcacctaggttaaagtaaagaaaaatatataaacccacaagaacacagggaccaggagaggagatgcattcattggattacgtttggttgtaaaaaaaacaaaaaatcctccccggcacggtggctcacaccttgtaatcccagcactttgggaggctgaggcaggcggatcacgaggtcacgagtttgagaccagcctgaccaacatggtgaaacctcatctctactaaaaatacaaaaattagccgggtgtggtggcgtacgcctgtaatcccagctactgaagtggctgagacaggagaattgcttgaacccgggaggcggaggttgcagtgagccgagatcacgccactgcactccagattaggtgacagaacaagactccatctcaaacaaaaacaaaaacaaaaacaaactaatataacagtgactttacatgctatgggttttttttctcctctcatcttcaagaaatgtggagactgccagtccggggatgatacagcatcacagtgtcaggaatctgctctttctgtataattgttacaggaaaggggtccggatccagaccccaagagagggttcttgaattcagggcaagtccacagtgcaaagtgaaagcaagtttactaagaaagtaaaggaataaaaaaatcgctactccatagacagagcagccctgagggctgctggttgcccatttttatggttatttcttgatgatatgctaaacaaggggtggattattcatgcctcccctttttagaccatatagggtaacttcctgatgttgccatggcatttgcaaactgtcatggtgctggtgggggcgtagcaccaaggaggaccagaggtcactcttgtggcctttgtggttttggtgggttttggccagctcctttactgcaacctgttttatcggcaaggactttatgacctgtattttgtgttgaccttgtatctcatcctgtgacttagaatgccttaaccatctgggaatgcagcccagtaggtttcagcctcattttacccagctcctattcaagatggagttgcagccgggcacggtggttcatgcctgtaatcccagcactttgggaggttgaggcgggtggatcacaaggtcaagagttcaagaccagcctggccaacatggcaaaaccccatctctactaaaaatacaaaaattagccaggcgtggttggtgtgcgcctattatgccagctacttgggaggctgatgcaggagaatcacttggatctgggaggcggaggttgcagtaagcagatatcgcgccatgcactccagcctggatgacagagcaagactccgtctcgggggaaaaaaaaaccaaaatggagttgctctggtttacaggcctctgacataatggctttatgtacatggcttccatggctagggtcagctcatagatctaatatggctgtgttggtgctcatgttgcagcccagcaatcagaaagagaaaggaggctgggtttggtggcttacacctgtcatcccagcatttcgggaggccaaggcgggaggatcacatgagcccatgagtttgagaccagcttgagcaacacagggagacctcatctctacaagaaataaaaataaattagttgggtatggtggcatgcacctgtggtcccagctattcgggaggctgaggtgagaggataccttgagcctggaggtttgaggctgcagtgagctatgatcgcaccactgcactccagcctgggcaacagagtgagaccccatctcaaataattaaaaaaaaaaaaaagaaagaaagaaaaaaaaaaggagagcagaaaaaggctatgtaccttttctttcgggttaccttctcaaagttgtgcatactacttccgtttacattacattggccagaacttaacatgacaactactagctacaaggtggtttttattctgggttgccatgcatcttagcttaagtaccctacaggtcctgagataatgattcctatgaaaatgattatttacttatttaattaatttattttgagatggagtctcactctgtcacccaggctggagatcagtggcgtgatctcggctcactgcaacctctgcctcccaggttcaagcaattctcctgcttcagtctcccgagtagctgggactacaggcatgcgccaccatgcccagcttttttgtatttttagtagagacggggtttcactatgttggccaggctgatctcgaactcctgacctcaggtgatctgcctgcctcggcctcccaaagtgctgggattacaggcgtgagccactgtgcctggctgaaaatgattttttaaaagtgttccaggaggaaatggaaagggcataggggagtaagaaagtggaaataggaaaagaaggaagccaagcaagaggagcctatcaagcaaagcctcagtcctgcagacagtctggaggcaggatattcacatcttagagttgtccaaaacagaacaggcaagctgcataattttcaactctggctgaataaggttgcatttcagctctctgggcacctggaaagtatgggctccagtaacctggaggcagtctgctgactgctggctggtgtgcacaaaagtggtaaagggatgagggagtgcaatatgggcactggcatcttggctgtcatgcatccaggtaaaaagtggaggctcaattactatatatgaaggggagaacagactttggggaacaattagcagtcatttccaggtgagacaacaacagaagagaaatgctaatttttttttttttctttgagatggagtttcgctcttgttgcccaggctggagtgcaatggcgctatatccagctcaccgcaacctccgcctcctgggttcaagtgattctcctgcctcagcctcccgagcagctgagattacaggccaccacacccagctaattttgtatttttagtagagacggggtttctccatgttggtcagggtggtctcaaactcccaacctcaggtgatccgcccgcctcagcctcccaaagtgctgggattacaggcgtgaaccaccgcacccggcgagagatgcgaacattttttttgttttttggaggatgacaagttgatgcaggaatgagcagaaccaggaggctgaatactgagtgttaaagagttcctagcaatatgcaggaaaggaaagcaacaagtatcctgagaggtgggggttagatgtagactgaaatcaggaggtgtggttaaaactctttgaaagaggctgggtgcggtggctcacataatcccagcactttgggaggccaaggcgggtgcatcatgaggtcaggagttcgagaccagcctgaccaacatgtgaaaccccgtctctactaaaaatacaaaaattagccgggcatggtggcgcatgcctgtaatcccagctactaaggaggctaaggcaggagaaccgcttgaacctgggaggcgaaggttgcagtgagccgagatcatgccattggactccagcccaggcgacagagagagatcccatctcaaaaaaaaaaaaaaaaaaaaaaaaaaagaaaggaaaagaagaaaagaaaaaagaaacagcagattccctagagaggagacattcatcactaaaaaaaaaaaaaaaaattaaaataaatcgcagaagtaaaagccctttttgaaagggctcagggtacccagcttaatgtatgaaacaaaagcaaacccacatcaaagcacaccattattaatttcagagcatcagaaataaagagaagatctgacaagcttcttggaagaaaacaaggcatagagaataatcagagtagagtagagcaggaaaacagagtcctgggtagagcgaactgagcctagccaatcgatagaattcttgatgttttgttgaaaacagaagcactttacaattctcttggtaagttttagaaagattctgtagtaatggaaaattgtacaaatttaaaaaatggaatctgttaacttcaggaagaacaaaaggtagaaaaatcaaggcaatataatcttggtacaacatttgacttagctgcaatgaataagacttacatagtcatagaaggtaaacactgattacttactttaccaaaaattatgatatcatcatattgaaagcccagaaggaagggaaataaagggaaatacaagagtgctaaatcttttatttttcaataagttggtaatgtctaaaattaataagaaaatggcaaccataagcctaatgcttagaaattcagaaaagtatcagactaaattttaaagtctactttaaactgagtctttgctttatagttgcataaataaattcattttgatggttttctcagaacagatgaactggctgggtgcggtggttcatgcctgtaatcttagcactttgggaggccaaggccgatggctcacttcaagtcaggagtttgagaccagccaaaaaattagccgggtgtggtggtgcacgtttgtaataccagctactcaggaggctgaggcaggagaatcgcttgaacctgggaggcggaggttgcagtgagccaagatggaacgactgcactccagcctgggtgacacagtgagactccgtctcaaaaaaacacaaagaacagatgaactgttttcctttgaggaatattgatgatcccactgcttgagtaatggaaaccagcttgcagctgatagttattttttgtcttttttcctgttctatccactgtcctaggtttggaatttcagctgggcagcttcgatcccaccacctgtagccactgaggttcacaggctctgtttgaggtgttgtgttagattgtgctgggttggttttgctgcttattgagtgatgaagagcaacatattagctactgagatattttgcagaaaaaggaagagatgtcttcagctcaaatgctatcaaacttgtatgtcttttaactttttattataaaaaatttcaaacatatgcaaaagcaaaagactagtttaatgaaccttatgtacccaccacccagtttcaacaattatcagttcctgacaattcttgtttcacctatcccacctctattatacacacatacaaacacacagacaccacacacacacacacacacacacacacgagagcaaagtcaacttccattattttgaagcacatccaagacatcacatcacattatttatcacattatttattaagtttcttcagtcacagtccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcgggtaagcggtcttttccatcctctcttgctacccttcaatctccctctctcgctacccttcaatctccctgtccttccaattccagttctttttcctctctagtagagacaaaggagacacattttatccgtggacccaaaattccggcgctggtcacggactcaagaagacagtcttctcttggtgtttaatcactgcagggacgactgcctgattattcacccacactccattggtgtctgatcaccgtgggggtgcctgtcttggtcattcacccacattcccttggtggcaagtcaattgcggggacgcctgctttggctgctcacccacccccttctccgtgtctctacctttctctttaaacttacttccttcactatgggcaacattccgtcctccattcccccttctactcccttagcctgtgttctcaagaacttaaaacctcttcaactcacacctgacctaaaacctaaaagccttattttcttctgcaataccgcttggccccaatacaaactcaacagtagttccaagtggccagagaatagcactttggatttgtctgtcctacaggatctagataatttttgttgaaaaatgggcaaatggtctgaggtgcctcagatccaggcattcttttacacactggtccctccctagtctctgctcccagtgcgactcatcccaaatctttcttctttctctcctgtctgttccttcagtctccaccccaagctccgagtcctttgaatcctccttttctatggactcatctgacctctcccctcttccccaggctgctcctcaccaggctgagccaggtcccaattcttcctcagcctccggtcccccaccctataatccttttatcaccccctcctcacaccgtgtctggcttacagtttctttctgtgactagccctcccctacctgcccaacaatttcttcttaaagaggtggctggagctgaaggcatagccaagggtaatgctcctttttctttatctgacctctcccaaatcagttagcgtttaggctctttttcatcaaatataaaaactcaacccagttcatggcctgtttggcaacaacccttggacactttaccgccctagacccagaatggccagaaggccgtcttattctcaacatgcattttattacccaacccactcccgacattagaaaaagctccaaaaattagattccggccctcaaaccccacaacaggacttaattaacatcaccttcaaggtgtacaataatagagtagaggcagccaagtagtaacgtatttctgagttgcaattccttgcctccactgtgagacaaaccccagccacatctccagcacacaagaccttccaaatgcctgaactgcagcggccaggcattcctccaggactgcctaccccaggatcttgcttcaagtgccggaaatctggccactgggccaaggaatgcccccagcccaggattcctcctaagccatgtcccatctgtgcaggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagagggtaggtccatcccctgtttaatcgatatgggagctacccactccacattaccttcttttcaagggcctgtttcctttgcccctataactgttgtgggtattgatggccaggattctaaaccccttaaaactcccccactctggcaccaacttggacaacattcttttatgtactcttttttagttatccccacctgcccagttcccttattaggccaagacattttaaccaaattatctgcttccctgattattcctggactacagccacatctcattgccacccttcttcccaacccaaagcctccttcgcctcttcctctcgtatcccccaaccttaacccacaagtatgggacacctccactccctccctggcaaccgatcaaacacccattactatcccattaaaacctaatcacccttacctggctcaatgccactattccatcccacaactggctttaagaggactgaagcctgttatcactcgcctgctacagcatgggcttctaaaacctataaactcttcttacaattctcccattttacctgttcaaaaaccggacaagtcttacaggttacctcaggatctggatcttatcaaccaaattgttttgcctatccaccctgtggtgcccaacccatacacttgtttgtcctcaataccttcctccacaactcactattccgttcttgatctcacagatgcttttttcactattccctacaccactcatcccagcctcttttgcttttacctggactgaccctgacacccatcagtcccagcagcttacctgggctgtactgccgcaaggcttcagggacagccctcattacttcagccaagctctttctcatgatatactttctttccatcccttcgcttctcaccttattcaatatattgatgaccttctactttgtagcccctcctttgaatcttctcaacaagatacttttcaacatttattctccaagggatatcggatgtccccctccaaagctcaaatttcttctccatccgttacctacctcagtataattcttcataaaaacacatgtgctctccctgctgatcatgtctgactgatctctcaaaccccaacaccttctacaaaacaacaactcctttccttcctgggcatggttggatacctttgcctttggatacctggttttgccatcctaacaaaaccattatataaactcacaaaagcaaacctagctgacctcataaatcctaaatcctttccccactcccctttccattccttaaaaaacagccctaaaagctgctcccacactagctctccctaactcatcccaacccttttttcattacacacagctgaaatgcagggctgtgcagttggaattcttacacaagagccaggaccatgccctgtagcctttctgtccaaacaacttgaccttactgttttaggctagcccccacattattcctgataccacacctgacccccatgactgtatctctctaatccacctggcattcactccatttccccatacttccttctttcctattcctcaccctgatcacacttggtttattgatggcagttccacctggcctaatcgccattcaccagcaaaggtgggctatgctatagtagtatcttccacatctatccttgaagctaccgctctgcccccctccactacctctcagcaagctgaactcattgccttaactcgagccctcgctcttgcaaaaggactacatgtcaatatttatactgactctaaatatgccttccatatcctgcaccacaatgctgttatatgggcagaaagaggtttcctcagtacgcaaaggtcctccatcattattgcctccttaataaaaactcttctcaaggccgctttacttccaaaggaagctggagtcattcactgcaagggccatcaaaaggcatcagatcccatcgctcagggcaatgcttatgctgataaggtagctaaagaagctgctagctttctaacttctgtccctcacggccagtttttcttcttctcatcagtcactcccacctattcaccgactgaaacttccacctatcaatctcttctcacacaaggcaaatggttcttagaccaaggaaaatatctccttccagcctcacaggcccattctattctgttgtcatttcataacctcttccatgtaggttacaagccactagcccacctcttagaacctctcatttcctttccatcatggaaatctatcctcaaggaaatcacttctcagtgttccatctgctattctactacccctcagggattattcaggccccctccctaccctatacatcaagttcagggatttgcccccacccaggactagcaaattgactctattcacatgccctgagttaggaaactaaaatacctcttggtctgggaagacactttcactggatgggtagaggcctttcccacagggtctgagaaggccaccacagtcatttcttcccttctgtcagaaataatttctcggtttggccttcccacctttatacagtccgataacggactggcctttactagtcaaatcacccaagcagtttctcaggctcttggtattcagtggaaccttcataccccttaccgtcctcaatcttcaggaaaggtagaacggactaatggtcttttaaagacatctcaccaagctcagcctccaacttaaaaaggactggacagtatttttacctcttgcccttcacagaattagagcccgtcctcgagaagctacagggtacagtccatttgaacttttatatggacgcactttcttgctcagccccaacctcgttccagacaccagccctctaggcgactatcttccagtcctctggcaggctagacaggaaatccaccaggctgctaatcttctcttgtctactccagattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggacaaccagcctaatctctcttcttcctcctggaagtcacaagtactccccactacttcccttaaagtcactctcatttctgaagaacagtaataacccttatgagcctaatacatcccttcattctattagctctattcatccttaccctactttttgcaacagggctttacacagtcaccccccctacttggactgaaccccaaaaacttgtcatccctactatcttctgtttactcatactcccattcactattctcaactactcataaatgccctaatcttgtttacattgcctgtttacactgtttctctaagccatcacagctggtatctcctggtgctatccccaaaccgccactcttaactccctcttagagtggatagatgatatttgctggcagggcaacctccaatattttcactctgatgaagttctattctttacttttatactcactcttattctcattcccattcttatgccaccctctacctctccccagctatctccaccacactatcaatcttactctctcctagccgtttctaatccctccttagcgaataattgctggctttgcatttccctttcttcctgcacctacacagctgcccccgccttatatacagactgggcaacatctcctgtctccctacacctccaaatttcctttaacagccctcatctttaccctcctgaagaacttcttcactttctagacaggtccagcaaggcctccccagacatttcacatcagcaagctgccgccctcctccacacttacttaaaaaacctttctccttatatcaactctactccccccacatttggatccctcacaacacaaactacttttcctgtggctgctcctttatgtatctctcagcaaagacccactggaattcccctgggtaacctttcaccttcttgatgttcattcactcttcatctccaaagcccaactacacacatcactgaaacaactggagccttccagctccgtattacagataagccttttatcaatacaggcaaacttaaaaacattagaagtaattattgcttaggaagacaccctgtatttcactccatccttggctaccttccccttgctcgtcagaccctcctcccaggccttcttgttatacccagccccgtaaataacagtgaaaggttgctcatagacactcgacgttttctcatacaccatgaaaattgaacctctccctctacacagttaccccatcagtccccattacaacctctgacggctgccgccctagctggatccctaggagtctgggtacaagacacccctttcagcactccttctcatctttttactttgcatttccagttttgcctggcacaagctctcttcttcctctgtggatcctctacctacatgtgtctacctgctaactggacaggcacatgcacactcattttccttaatcccaaaattcaatttgcaaatgggaccaaagagcttcctgttcctctcatgacaccgacatgacaaaaaagggttattccactaattcccttgcttgtcggtttaggactttctgcctcctctattgctctcggtactggaatagaaggcatttcaacctctgtcacaaccttccatagcctctctaatgacttctccactagcatcacagacatatcttaaactttatcagtacttcaggcccaagttgactctctggctgcagttgtcctccaaaactgccaaggccttgacttactcactgctgaaaaaggaaggcgctgtgtgtatgtgtgtgtgtatatatatatatatatatatatatatatattttttttttttttttttttttttttttttgagacggagtcttgctctgtcacccaggcagtggcgcatctcggctcactgctcactgcaagctccacctcctgggttcatgccattctcctgcctcagcctcccaagtagctgggactataggcgcctgccaccacgcccggctaattttttgtatttttttagtacagacagggtttcaccatgttagccaggatggtctcgatctcctgacctcatgatccgcctgcctcggcctcccaaagtgctggggttataggcgtgggccactgcgcccggccgggctctgtatatttttaaatgaagagtgttctttttacctaaatcaatctggcctggtgtatgacaatataaaaaaactcaaggacagagtccaaaaacttgccaaccaagcaagtaattatgctgaacccccttgggcactctctaatcggatgtcctgggtcctcccaattcttagtcctttaatacctgtttttctccttctcttatttggaccttgtgtcttccgtttggtttctcagttcatccaaaaccatatccaggccatcaccaatcattctatatgacaaatgctccttctaacaaccccacagtatcactccttaccacaaaatcttccttcagcttaatctctcccactctaggttcccacaccacccctaataccgctcgaagcagccctgaggaacatcgcccattatctctccatactaccccccaaaattttcaccactccaacacttcaacactattttgttttatttttcttattaatataagaagacaggaatgtctggcctctgagccaaggcctgcatgtatacatccagatggcctgaaggaactgaagaatcacaaaagaagtgaaaatggctgattcctgccttaactgatgacattaccctgtgaaattccttctcctggctcagaagctcccccaccaagcaccttgtgacccccccgcccctgcctgccagagaacaaccccctttgactgtagttttccactacccacccaaatcctataaaactgccccacccctaacaccctttgctgactctcttttgggactcagcccacctgcacccaggtgaaataaacagctttattgctcacacaaagcctgtttggaggtctcttcacacggatgcccgtgacaagtgcctgccaccacatcccactaatttttgtatttttagtagagatggggtttcaccatgttggccaggctggtcttgaacgcctgacctcaggtgatccacctgcctcggccttccaaagtgctgagattacaggcgtaagcccctgcacccggccctgttttttttttttttttttttttttacatcccggagtcacactggatatctgaatgtgcttaaaataaaattcacatctcattctggaagtgtttattaaatgctgtccctgcattcatgtgaacatcacagcccagcggttagatgtgcagactccaacgcctgactgcctgggtctgtcacttactagctgtatgaccttggatgggttacttaacatttctgggcactggtttctcattagtaaaatgaagaatgggcgcctgtagtcccagctacttgggagcctgaggcaggagaatcgctttaacccgggagacgaggttgcagtgagcctaggtcccgccattgcactccagcctgggccacagagcgaggctccatctcaaaaaataaaatttaaaaaaaaaaaattcagctttcacggagaattactactgcctggtgccatcagatcccaaatactggaggcattcccaatgttctgttcacaaactgtgcaatctgtgatagcccctcttgtgaatataatcaaagtgaaagatgccagtatacttattgctatgcttaaaagaactgcagatctatcatatccttttgaaaccaaaaaatgtggaagtctccctggctagatgctgtgtgtccacgtatcctgcaccaattgcttgaaagtcacatgacaacctttcttcctttagggaaggaagcaagcaaggtaggactctgtgtgttacagccagtgtgggtaactaaggactgagggaggtgtgggcacttgcatagctagtgccgccaataccataggagcgttgacactaaacggcacttctctattaagttgccctgctgtcttctaacgagtcattttgaaaaacggttgtccgtttttcaactacttgggtgagggcagcttcatgaaaaaagctcatcgtatgttaaagaaggtagggtttcaattgtgagctataaagccaccagaggagatttctcctatagaaggaaggtgtgtttcctgcttggacacctgaatttgcaacccatcctttcttttttcctttttccttttttttttttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaaggtaacagctggagcgagggaagggagggcttttctaagaccctgggaacgtccgtttggtccctacttccatcagtcaggagacgcggacaggtcgcaaaggaatgctgctcctcccttttttcttcacacacctcctcttgcctcttctcaacagattttctatgatgaaagaccactgggggccaggggaagagtcctggttctcctctctttaaatattctggatatctcaaagtacagtagagtgaaactgctcctacgttaagtcgagtttattttcgtttggttgatccacgcccaccactttgccctcagtttgggggctgatctcattcttaacatcttcctgtattctgacccagtttaaagaattgtatatctgttttctatttttgtaacagttgaaataactcataatttaaacacttggtgagttttgctcttttctgtcttgagtatgttatgaaacacggccatgtttttctatttaattattttttacttttccttattgtgatgatacattatagcgttccagctgagaatgtatttttgtgtataatcgcccatttcgcccatatttcgacagtagaatagggaagacaaccctattcttaaggtacccttagcaatcttcactcatttttgaagtcctcaatctcgttttactaatgaatagtgacccagagttacatggtaatcaatggctacattagttactatccattaattactattttgatttcttggcattttagtaagcaatgtttggatcaaaacagtttttaagtttcaatctaagtctgctccagggagataatgggctgttcttttgggtgagagctgctgctttgacaattgtatttcttataaataaatttaataaattagta

SEQ ID NO: 6 - DNA, 23 bp, Artificial sequence
  Primer
ctatcaggacagagttcacatcc

SEQ ID NO: 7 - DNA, 23 bp, Artificial sequence
  Primer
gtttctaaagacatggtcacagc

SEQ ID NO: 8 - DNA, 22 bp, Artificial sequence
  Probe
aaaggccagccaccagttcagg

SEQ ID NO: 9-11 - skipped (3 entries)

SEQ ID NO: 12 - DNA, 20 bp, Artificial sequence
  Primer
ccttcttcctgcgccttatt

SEQ ID NO: 13 - DNA, 23 bp, Artificial sequence
  Primer
tcatggtgggtacgtatgtttag

SEQ ID NO: 14 - DNA, 25 bp, Artificial sequence
  Probe
agtatgcaggcaagtctccttctgt

SEQ ID NO: 15 - DNA, 20 bp, Artificial sequence
  Synthetic oligonucleotide
accaccccctccagctccgc

SEQ ID NO: 16 - DNA, 20 bp, Artificial sequence
  Synthetic oligonucleotide
gaaccaccccctccagctcc

SEQ ID NO: 17 - DNA, 20 bp, Artificial sequence
  Synthetic oligonucleotide
tgatctttcatttataggat

SEQ ID NO: 18 - DNA, 20 bp, Artificial sequence
  Synthetic oligonucleotide
aatgatctttcatttatagg

SEQ ID NO: 19 - DNA, 20 bp, Artificial sequence
  Synthetic oligonucleotide
gagagaattcaagttaaacc

SEQ ID NO: 20 - DNA, 20 bp, Artificial sequence
  Synthetic oligonucleotide
tggacccgtcaagagagaat

SEQ ID NO: 21 - DNA, 20 bp, Artificial sequence
  Synthetic oligonucleotide
taattcttctccaataagtt

SEQ ID NO: 22 - DNA, 20 bp, Artificial sequence
  Synthetic oligonucleotide
tgctaattcttctccaataa

SEQ ID NO: 23 - DNA, 20 bp, Artificial sequence
  Synthetic oligonucleotide
ctgaatagccctgcggagat

SEQ ID NO: 24 - DNA, 20 bp, Artificial sequence
  Synthetic oligonucleotide
tacttagctgaatagccctg

SEQ ID NO: 25 - DNA, 20 bp, Artificial sequence
  Synthetic oligonucleotide
tgacacattaccaaagtgga

SEQ ID NO: 26 - DNA, 20 bp, Artificial sequence
  Synthetic oligonucleotide
ctttgacacattaccaaagt

SEQ ID NO: 27 - DNA, 20 bp, Artificial sequence
  Synthetic oligonucleotide
tggttaataagaaatgaaag

SEQ ID NO: 28 - DNA, 20 bp, Artificial sequence
  Synthetic oligonucleotide
aatttggttaataagaaatg

SEQ ID NO: 29 - DNA, 20 bp, Artificial sequence
  Synthetic oligonucleotide
aaaagattaccatctttcaa

SEQ ID NO: 30 - DNA, 20 bp, Artificial sequence
  Synthetic oligonucleotide
agaaaagattaccatctttc

SEQ ID NO: 31 - DNA, 20 bp, Artificial sequence
  Synthetic oligonucleotide
tcctagttttctcaattgga

SEQ ID NO: 32 - DNA, 20 bp, Artificial sequence
  Synthetic oligonucleotide
tctcctagttttctcaattg

SEQ ID NO: 33 - DNA, 20 bp, Artificial sequence
  Synthetic oligonucleotide
caagctatacctactaaaag

SEQ ID NO: 34 - DNA, 20 bp, Artificial sequence
  Synthetic oligonucleotide
gacaagctatacctactaaa

SEQ ID NO: 35 - DNA, 20 bp, Artificial sequence
  Synthetic oligonucleotide
ccattgttcttaagctatct

SEQ ID NO: 36 - DNA, 20 bp, Artificial sequence
  Synthetic oligonucleotide
atttatagatccactaagta

SEQ ID NO: 37 - DNA, 20 bp, Artificial sequence
  Synthetic oligonucleotide
agcttatgaacaattcaaca

SEQ ID NO: 38 - DNA, 20 bp, Artificial sequence
  Synthetic oligonucleotide
attttagcttatgaacaatt

SEQ ID NO: 39 - DNA, 20 bp, Artificial sequence
  Synthetic oligonucleotide
ttagcaataaatcctagatc

SEQ ID NO: 40 - DNA, 20 bp, Artificial sequence
  Synthetic oligonucleotide
agttagcaataaatcctaga

SEQ ID NO: 41 - DNA, 20 bp, Artificial sequence
  Synthetic oligonucleotide
gagggagtagtactaaactc

SEQ ID NO: 42 - DNA, 20 bp, Artificial sequence
  Synthetic oligonucleotide
agctttttaaatcttgaggg

SEQ ID NO: 43 - DNA, 20 bp, Artificial sequence
  Synthetic oligonucleotide
gctcatcaattcaagtgtat

SEQ ID NO: 44 - DNA, 20 bp, Artificial sequence
  Synthetic oligonucleotide
tagctcatcaattcaagtgt

SEQ ID NO: 45 - DNA, 20 bp, Artificial sequence
  Synthetic oligonucleotide
gcatattggttttctcattt

SEQ ID NO: 46 - DNA, 20 bp, Artificial sequence
  Synthetic oligonucleotide
aaacacattcaaacgcatcc

SEQ ID NO: 47 - DNA, 20 bp, Artificial sequence
  Synthetic oligonucleotide
acaaacacattcaaacgcat

SEQ ID NO: 48 - DNA, 20 bp, Artificial sequence
  Synthetic oligonucleotide
tggccaatcaattaagaaat

SEQ ID NO: 49 - DNA, 20 bp, Artificial sequence
  Synthetic oligonucleotide
tcatactggccaatcaatta

SEQ ID NO: 50 - DNA, 20 bp, Artificial sequence
  Synthetic oligonucleotide
ttagttgttcctgactttct

SEQ ID NO: 51 - DNA, 20 bp, Artificial sequence
  Synthetic oligonucleotide
ttcttgtgaatttagttgtt

SEQ ID NO: 52 - DNA, 20 bp, Artificial sequence
  Synthetic oligonucleotide
gtaatacaaattatacatta

SEQ ID NO: 53 - DNA, 20 bp, Artificial sequence
  Synthetic oligonucleotide
ccagtaatacaaattataca

SEQ ID NO: 54 - DNA, 20 bp, Artificial sequence
  Synthetic oligonucleotide
actcattaaatccatgacat

SEQ ID NO: 55 - DNA, 20 bp, Artificial sequence
  Synthetic oligonucleotide
ttactcattaaatccatgac

SEQ ID NO: 56 - DNA, 20 bp, Artificial sequence
  Synthetic oligonucleotide
cagccttttcaaacagttta

SEQ ID NO: 57 - DNA, 20 bp, Artificial sequence
  Synthetic oligonucleotide
agcagccttttcaaacagtt

SEQ ID NO: 58 - DNA, 20 bp, Artificial sequence
  Synthetic oligonucleotide
tagtatcaaaaattcagaca

SEQ ID NO: 59 - DNA, 20 bp, Artificial sequence
  Synthetic oligonucleotide
gttttaagaatttagtagct

SEQ ID NO: 60 - DNA, 20 bp, Artificial sequence
  Synthetic oligonucleotide
tcgatacaacaaacaattca

SEQ ID NO: 61 - DNA, 20 bp, Artificial sequence
  Synthetic oligonucleotide
actcgatacaacaaacaatt

SEQ ID NO: 62 - DNA, 20 bp, Artificial sequence
  Synthetic oligonucleotide
gactaaaaaaatacaaagcc

SEQ ID NO: 63 - DNA, 20 bp, Artificial sequence
  Synthetic oligonucleotide
tcaataatcttcactcatga

SEQ ID NO: 64 - DNA, 20 bp, Artificial sequence
  Synthetic oligonucleotide
acatttaaaaatgtatgttt

SEQ ID NO: 65 - DNA, 20 bp, Artificial sequence
  Synthetic oligonucleotide
aattagataatcacatttaa

SEQ ID NO: 66 - DNA, 20 bp, Artificial sequence
  Synthetic oligonucleotide
gccaaacaacaatgcttttt

SEQ ID NO: 67 - DNA, 20 bp, Artificial sequence
  Synthetic oligonucleotide
tggccaaacaacaatgcttt

SEQ ID NO: 68 - DNA, 20 bp, Artificial sequence
  Synthetic oligonucleotide
atttaataatctttgatatt

SEQ ID NO: 69 - DNA, 20 bp, Artificial sequence
  Synthetic oligonucleotide
ttatctttatttaataatct

SEQ ID NO: 70 - DNA, 20 bp, Artificial sequence
  Synthetic oligonucleotide
ctcctccttctgccattctc

SEQ ID NO: 71 - DNA, 20 bp, Artificial sequence
  Synthetic oligonucleotide
agtaactcctccttctgcca

SEQ ID NO: 72 - DNA, 20 bp, Artificial sequence
  Synthetic oligonucleotide
ctaccctaatacaagagact

SEQ ID NO: 73 - DNA, 20 bp, Artificial sequence
  Synthetic oligonucleotide
aaaccctacaaatactgaat

SEQ ID NO: 74 - DNA, 20 bp, Artificial sequence
  Synthetic oligonucleotide
aaccaaacccaaacatcccg

SEQ ID NO: 75 - DNA, 20 bp, Artificial sequence
  Synthetic oligonucleotide
gaaaccaaacccaaacatcc

SEQ ID NO: 76 - DNA, 20 bp, Artificial sequence
  Synthetic oligonucleotide
tcagcctatttcaaaagttt

SEQ ID NO: 77 - DNA, 20 bp, Artificial sequence
  Synthetic oligonucleotide
aaaattagtgacaactatac

SEQ ID NO: 78 - DNA, 20 bp, Artificial sequence
  Synthetic oligonucleotide
aaactcaaagccatctcttt

SEQ ID NO: 79 - DNA, 20 bp, Artificial sequence
  Synthetic oligonucleotide
ccatatatatctcagaaact

SEQ ID NO: 80 - DNA, 20 bp, Artificial sequence
  Synthetic oligonucleotide
aagtcatttatacagaattt

SEQ ID NO: 81 - DNA, 20 bp, Artificial sequence
  Synthetic oligonucleotide
cagaggtttcaaaacctgtg

SEQ ID NO: 82 - DNA, 20 bp, Artificial sequence
  Synthetic oligonucleotide
ttatctcaaactatccccag

SEQ ID NO: 83 - DNA, 20 bp, Artificial sequence
  Synthetic oligonucleotide
cccttatctcaaactatccc

SEQ ID NO: 84 - DNA, 20 bp, Artificial sequence
  Synthetic oligonucleotide
agtttacaaactatggtcac

SEQ ID NO: 85 - DNA, 20 bp, Artificial sequence
  Synthetic oligonucleotide
tggagtttacaaactatggt

SEQ ID NO: 86 - DNA, 20 bp, Artificial sequence
  Synthetic oligonucleotide
taaccaataataactaataa

SEQ ID NO: 87 - DNA, 20 bp, Artificial sequence
  Synthetic oligonucleotide
attggtataaccaataataa

SEQ ID NO: 88 - DNA, 20 bp, Artificial sequence
  Synthetic oligonucleotide
ctgtcccaaacaaccctgga

SEQ ID NO: 89 - DNA, 20 bp, Artificial sequence
  Synthetic oligonucleotide
cagaactgtcccaaacaacc

SEQ ID NO: 90 - DNA, 20 bp, Artificial sequence
  Synthetic oligonucleotide
ttacatgatcaaaaatttaa

SEQ ID NO: 91 - DNA, 20 bp, Artificial sequence
  Synthetic oligonucleotide
tttattttacaaatctacca

SEQ ID NO: 92 - DNA, 20 bp, Artificial sequence
  Synthetic oligonucleotide
acggtgaaaccccactatct

SEQ ID NO: 93 - DNA, 20 bp, Artificial sequence
  Synthetic oligonucleotide
ctatataaaaatctagtact

SEQ ID NO: 94 - DNA, 20 bp, Artificial sequence
  Synthetic oligonucleotide
ataaacaaagatatctgcag

SEQ ID NO: 95 - DNA, 20 bp, Artificial sequence
  Synthetic oligonucleotide
agcaaggcacaaataggaaa

SEQ ID NO: 96 - DNA, 20 bp, Artificial sequence
  Synthetic oligonucleotide
atatatcactaaatccataa

SEQ ID NO: 97 - DNA, 20 bp, Artificial sequence
  Synthetic oligonucleotide
tagatatatcactaaatcca

SEQ ID NO: 98 - DNA, 20 bp, Artificial sequence
  Synthetic oligonucleotide
attaacttgaaatattgaat

SEQ ID NO: 99 - DNA, 20 bp, Artificial sequence
  Synthetic oligonucleotide
atctttcatttctaaaaaag

SEQ ID NO: 100 - DNA, 20 bp, Artificial sequence
  Synthetic oligonucleotide
tgacactatttcaggctttg

SEQ ID NO: 101 - DNA, 20 bp, Artificial sequence
  Synthetic oligonucleotide
gaatgctttattcatgcttg

SEQ ID NO: 102 - DNA, 20 bp, Artificial sequence
  Synthetic oligonucleotide
taagaaagaaccaacttagg

SEQ ID NO: 103 - DNA, 20 bp, Artificial sequence
  Synthetic oligonucleotide
gaagaactttaagaaagaac

SEQ ID NO: 104 - DNA, 20 bp, Artificial sequence
  Synthetic oligonucleotide
tagtgaaaaatatagtttta

SEQ ID NO: 105 - DNA, 20 bp, Artificial sequence
  Synthetic oligonucleotide
tatagtgaaaaatatagttt

SEQ ID NO: 106 - DNA, 20 bp, Artificial sequence
  Synthetic oligonucleotide
acatttttttaaaagagatg

SEQ ID NO: 107 - DNA, 20 bp, Artificial sequence
  Synthetic oligonucleotide
tcacatataacatataaaca

SEQ ID NO: 108 - DNA, 20 bp, Artificial sequence
  Synthetic oligonucleotide
ctgcagatttatcactatta

SEQ ID NO: 109 - DNA, 20 bp, Artificial sequence
  Synthetic oligonucleotide
gatcttaaaaactacaagag

SEQ ID NO: 110 - DNA, 20 bp, Artificial sequence
  Synthetic oligonucleotide
cgagtcagatcctaaaatca

SEQ ID NO: 111 - DNA, 20 bp, Artificial sequence
  Synthetic oligonucleotide
ggtggtagttaaagagtaat

SEQ ID NO: 112 - DNA, 20 bp, Artificial sequence
  Synthetic oligonucleotide
taacggaaagccacaaggaa

SEQ ID NO: 113 - DNA, 20 bp, Artificial sequence
  Synthetic oligonucleotide
gaacataattttaattgctt

SEQ ID NO: 114 - DNA, 20 bp, Artificial sequence
  Synthetic oligonucleotide
gtatctaaaatcaaagaatt

SEQ ID NO: 115 - DNA, 20 bp, Artificial sequence
  Synthetic oligonucleotide
caagtatctaaaatcaaaga

SEQ ID NO: 116 - DNA, 20 bp, Artificial sequence
  Synthetic oligonucleotide
atggaaaacctcaaaatagt

SEQ ID NO: 117 - DNA, 20 bp, Artificial sequence
  Synthetic oligonucleotide
tttaagtttctctatcatta

SEQ ID NO: 118 - DNA, 20 bp, Artificial sequence
  Synthetic oligonucleotide
gtgtgcaataactagtaaca

SEQ ID NO: 119 - DNA, 20 bp, Artificial sequence
  Synthetic oligonucleotide
tacattacccttcatatata

SEQ ID NO: 120 - DNA, 20 bp, Artificial sequence
  Synthetic oligonucleotide
gcctcatttttacctttgct

SEQ ID NO: 121 - DNA, 20 bp, Artificial sequence
  Synthetic oligonucleotide
aggcctcatttttacctttg

SEQ ID NO: 122 - DNA, 20 bp, Artificial sequence
  Synthetic oligonucleotide
aagggaaagcccactatata

SEQ ID NO: 123 - DNA, 20 bp, Artificial sequence
  Synthetic oligonucleotide
taagaaatctaaagggaaag

SEQ ID NO: 124 - DNA, 20 bp, Artificial sequence
  Synthetic oligonucleotide
ttaacatttttctttgccta

SEQ ID NO: 125 - DNA, 20 bp, Artificial sequence
  Synthetic oligonucleotide
acttcaaacttttaattaag

SEQ ID NO: 126 - DNA, 20 bp, Artificial sequence
  Synthetic oligonucleotide
aatcactgtatttaccaatt

SEQ ID NO: 127 - DNA, 20 bp, Artificial sequence
  Synthetic oligonucleotide
caacaaaaaccaatcactgt

SEQ ID NO: 128 - DNA, 20 bp, Artificial sequence
  Synthetic oligonucleotide
gagttgatccagatttatgg

SEQ ID NO: 129 - DNA, 20 bp, Artificial sequence
  Synthetic oligonucleotide
ggaattcctatttagcaagc

SEQ ID NO: 130 - DNA, 20 bp, Artificial sequence
  Synthetic oligonucleotide
tagaaatatctcacattaag

SEQ ID NO: 131 - DNA, 20 bp, Artificial sequence
  Synthetic oligonucleotide
aagactagaaatatctcaca

SEQ ID NO: 132 - DNA, 20 bp, Artificial sequence
  Synthetic oligonucleotide
tgattattattttatgacaa

SEQ ID NO: 133 - DNA, 20 bp, Artificial sequence
  Synthetic oligonucleotide
tattttttacattaactaga

SEQ ID NO: 134 - DNA, 20 bp, Artificial sequence
  Synthetic oligonucleotide
tctgaaataaacatggtgaa

SEQ ID NO: 135 - DNA, 20 bp, Artificial sequence
  Synthetic oligonucleotide
ttatagtttctctatgatgt

SEQ ID NO: 136 - DNA, 20 bp, Artificial sequence
  Synthetic oligonucleotide
aagaagttagttcttaactc

SEQ ID NO: 137 - DNA, 20 bp, Artificial sequence
  Synthetic oligonucleotide
tgaatgcaagccattgttaa

SEQ ID NO: 138 - DNA, 20 bp, Artificial sequence
  Synthetic oligonucleotide
gcatgaaaactatgattact

SEQ ID NO: 139 - DNA, 20 bp, Artificial sequence
  Synthetic oligonucleotide
atgcatgaaaactatgatta

SEQ ID NO: 140 - DNA, 20 bp, Artificial sequence
  Synthetic oligonucleotide
ttatgtaaacccctaatttc

SEQ ID NO: 141 - DNA, 20 bp, Artificial sequence
  Synthetic oligonucleotide
taatatcctcattacccatt

SEQ ID NO: 142 - DNA, 20 bp, Artificial sequence
  Synthetic oligonucleotide
ttagcaaatcctgatgctgc

SEQ ID NO: 143 - DNA, 20 bp, Artificial sequence
  Synthetic oligonucleotide
gtatcctcccattagcaaat

SEQ ID NO: 144 - DNA, 20 bp, Artificial sequence
  Synthetic oligonucleotide
tattattcccaaatggttca

SEQ ID NO: 145 - DNA, 20 bp, Artificial sequence
  Synthetic oligonucleotide
taatggaaaatcatatctgc

SEQ ID NO: 146 - DNA, 20 bp, Artificial sequence
  Synthetic oligonucleotide
cctttgatcagataaagcat

SEQ ID NO: 147 - DNA, 20 bp, Artificial sequence
  Synthetic oligonucleotide
gaaagtcaccaaaaataagt

SEQ ID NO: 148 - DNA, 20 bp, Artificial sequence
  Synthetic oligonucleotide
acattgtttcacgaatcaaa

SEQ ID NO: 149 - DNA, 20 bp, Artificial sequence
  Synthetic oligonucleotide
ataaggaaaatacattgttt

SEQ ID NO: 150 - DNA, 20 bp, Artificial sequence
  Synthetic oligonucleotide
catggtcacagctgcctgaa

SEQ ID NO: 151 - DNA, 20 bp, Artificial sequence
  Synthetic oligonucleotide
gacatggtcacagctgcctg

SEQ ID NO: 152 - DNA, 20 bp, Artificial sequence
  Synthetic oligonucleotide
tgaagtttaaattattatgt

SEQ ID NO: 153 - DNA, 20 bp, Artificial sequence
  Synthetic oligonucleotide
actgtacaaattactgtgaa

SEQ ID NO: 154 - DNA, 20 bp, Artificial sequence
  Synthetic oligonucleotide
ttatttcttcattaaagcca

SEQ ID NO: 155 - DNA, 20 bp, Artificial sequence
  Synthetic oligonucleotide
caaaaaaatgccaaactgtt

SEQ ID NO: 156 - DNA, 20 bp, Artificial sequence
  Synthetic oligonucleotide
gctgtcattcaaattgctta

SEQ ID NO: 157 - DNA, 20 bp, Artificial sequence
  Synthetic oligonucleotide
actagaaaaaatgttgtatg

SEQ ID NO: 158 - DNA, 20 bp, Artificial sequence
  Synthetic oligonucleotide
taaaatagttttctaaatgt

SEQ ID NO: 159 - DNA, 20 bp, Artificial sequence
  Synthetic oligonucleotide
aatattagccaaagaggcat

SEQ ID NO: 160 - DNA, 20 bp, Artificial sequence
  Synthetic oligonucleotide
tgtaaagatatttaagagag

SEQ ID NO: 161 - DNA, 20 bp, Artificial sequence
  Synthetic oligonucleotide
ctgtcaattcaaaggaagtt

SEQ ID NO: 162 - DNA, 20 bp, Artificial sequence
  Synthetic oligonucleotide
aaccaccccctccagctccg

SEQ ID NO: 163 - DNA, 20 bp, Artificial sequence
  Synthetic oligonucleotide
cgaaccaccccctccagctc

SEQ ID NO: 164 - DNA, 20 bp, Artificial sequence
  Synthetic oligonucleotide
ccgaaccaccccctccagct

SEQ ID NO: 165 - DNA, 20 bp, Artificial sequence
  Synthetic oligonucleotide
ttgtctggagccaacggccc

SEQ ID NO: 166 - DNA, 20 bp, Artificial sequence
  Synthetic oligonucleotide
ctccatgtttatttgtctgg

SEQ ID NO: 167 - DNA, 20 bp, Artificial sequence
  Synthetic oligonucleotide
actccatgtttatttgtctg

SEQ ID NO: 168 - DNA, 20 bp, Artificial sequence
  Synthetic oligonucleotide
agatggactccatgtttatt

SEQ ID NO: 169 - DNA, 20 bp, Artificial sequence
  Synthetic oligonucleotide
cccaaactttcaaggcattg

SEQ ID NO: 170 - DNA, 20 bp, Artificial sequence
  Synthetic oligonucleotide
ccccaaactttcaaggcatt

SEQ ID NO: 171 - DNA, 20 bp, Artificial sequence
  Synthetic oligonucleotide
accccaaactttcaaggcat

SEQ ID NO: 172 - DNA, 20 bp, Artificial sequence
  Synthetic oligonucleotide
aaccccaaactttcaaggca

SEQ ID NO: 173 - DNA, 20 bp, Artificial sequence
  Synthetic oligonucleotide
aaaccccaaactttcaaggc

SEQ ID NO: 174 - DNA, 20 bp, Artificial sequence
  Synthetic oligonucleotide
tctaaaccccaaactttcaa

SEQ ID NO: 175 - DNA, 20 bp, Artificial sequence
  Synthetic oligonucleotide
ttctaaaccccaaactttca

SEQ ID NO: 176 - DNA, 20 bp, Artificial sequence
  Synthetic oligonucleotide
gttctaaaccccaaactttc

SEQ ID NO: 177 - DNA, 20 bp, Artificial sequence
  Synthetic oligonucleotide
agttctaaaccccaaacttt

SEQ ID NO: 178 - DNA, 20 bp, Artificial sequence
  Synthetic oligonucleotide
tagttctaaaccccaaactt

SEQ ID NO: 179 - DNA, 20 bp, Artificial sequence
  Synthetic oligonucleotide
ttagttctaaaccccaaact

SEQ ID NO: 180 - DNA, 20 bp, Artificial sequence
  Synthetic oligonucleotide
gattagttctaaaccccaaa

SEQ ID NO: 181 - DNA, 20 bp, Artificial sequence
  Synthetic oligonucleotide
ggattagttctaaaccccaa

SEQ ID NO: 182 - DNA, 20 bp, Artificial sequence
  Synthetic oligonucleotide
aggattagttctaaacccca

SEQ ID NO: 183 - DNA, 20 bp, Artificial sequence
  Synthetic oligonucleotide
acaggattagttctaaaccc

SEQ ID NO: 184 - DNA, 20 bp, Artificial sequence
  Synthetic oligonucleotide
actgttgaacaggattagtt

SEQ ID NO: 185 - DNA, 20 bp, Artificial sequence
  Synthetic oligonucleotide
gagcctctgatactctggac

SEQ ID NO: 186 - DNA, 20 bp, Artificial sequence
  Synthetic oligonucleotide
tgagcctctgatactctgga

SEQ ID NO: 187 - DNA, 20 bp, Artificial sequence
  Synthetic oligonucleotide
cctgagcctctgatactctg

SEQ ID NO: 188 - DNA, 20 bp, Artificial sequence
  Synthetic oligonucleotide
cgatcctgagcctctgatac

SEQ ID NO: 189 - DNA, 20 bp, Artificial sequence
  Synthetic oligonucleotide
aggatcgatcctgagcctct

SEQ ID NO: 190 - DNA, 20 bp, Artificial sequence
  Synthetic oligonucleotide
taggatcgatcctgagcctc

SEQ ID NO: 191 - DNA, 20 bp, Artificial sequence
  Synthetic oligonucleotide
tataggatcgatcctgagcc

SEQ ID NO: 192 - DNA, 20 bp, Artificial sequence
  Synthetic oligonucleotide
ttataggatcgatcctgagc

SEQ ID NO: 193 - DNA, 20 bp, Artificial sequence
  Synthetic oligonucleotide
atctttcatttataggatcg

SEQ ID NO: 194 - DNA, 20 bp, Artificial sequence
  Synthetic oligonucleotide
atgatctttcatttatagga

SEQ ID NO: 195 - DNA, 20 bp, Artificial sequence
  Synthetic oligonucleotide
catataaatgatctttcatt

SEQ ID NO: 196 - DNA, 20 bp, Artificial sequence
  Synthetic oligonucleotide
gcatataaatgatctttcat

SEQ ID NO: 197 - DNA, 20 bp, Artificial sequence
  Synthetic oligonucleotide
tgcatataaatgatctttca

SEQ ID NO: 198 - DNA, 20 bp, Artificial sequence
  Synthetic oligonucleotide
ttgcatataaatgatctttc

SEQ ID NO: 199 - DNA, 20 bp, Artificial sequence
  Synthetic oligonucleotide
attgcatataaatgatcttt

SEQ ID NO: 200 - DNA, 20 bp, Artificial sequence
  Synthetic oligonucleotide
taattgcatataaatgatct

SEQ ID NO: 201 - DNA, 20 bp, Artificial sequence
  Synthetic oligonucleotide
tccttataattgcatataaa

SEQ ID NO: 202 - DNA, 20 bp, Artificial sequence
  Synthetic oligonucleotide
tgttccttataattgcatat

SEQ ID NO: 203 - DNA, 20 bp, Artificial sequence
  Synthetic oligonucleotide
gtgttccttataattgcata

SEQ ID NO: 204 - DNA, 20 bp, Artificial sequence
  Synthetic oligonucleotide
agtgttccttataattgcat

SEQ ID NO: 205 - DNA, 20 bp, Artificial sequence
  Synthetic oligonucleotide
cagtgttccttataattgca

SEQ ID NO: 206 - DNA, 20 bp, Artificial sequence
  Synthetic oligonucleotide
ccagtgttccttataattgc

SEQ ID NO: 207 - DNA, 20 bp, Artificial sequence
  Synthetic oligonucleotide
accagtgttccttataattg

SEQ ID NO: 208 - DNA, 20 bp, Artificial sequence
  Synthetic oligonucleotide
aaccagtgttccttataatt

SEQ ID NO: 209 - DNA, 20 bp, Artificial sequence
  Synthetic oligonucleotide
ctgtaaaccagtgttcctta

SEQ ID NO: 210 - DNA, 20 bp, Artificial sequence
  Synthetic oligonucleotide
taactgtaaaccagtgttcc

SEQ ID NO: 211 - DNA, 20 bp, Artificial sequence
  Synthetic oligonucleotide
ctaactgtaaaccagtgttc

SEQ ID NO: 212 - DNA, 20 bp, Artificial sequence
  Synthetic oligonucleotide
aattttctaactgtaaacca

SEQ ID NO: 213 - DNA, 20 bp, Artificial sequence
  Synthetic oligonucleotide
cctaattttctaactgtaaa

SEQ ID NO: 214 - DNA, 20 bp, Artificial sequence
  Synthetic oligonucleotide
tcctaattttctaactgtaa

SEQ ID NO: 215 - DNA, 20 bp, Artificial sequence
  Synthetic oligonucleotide
ttcctaattttctaactgta

SEQ ID NO: 216 - DNA, 20 bp, Artificial sequence
  Synthetic oligonucleotide
tttcctaattttctaactgt

SEQ ID NO: 217 - DNA, 20 bp, Artificial sequence
  Synthetic oligonucleotide
gttttcctaattttctaact

SEQ ID NO: 218 - DNA, 20 bp, Artificial sequence
  Synthetic oligonucleotide
actgttttcctaattttcta

SEQ ID NO: 219 - DNA, 20 bp, Artificial sequence
  Synthetic oligonucleotide
ccactgttttcctaattttc

SEQ ID NO: 220 - DNA, 20 bp, Artificial sequence
  Synthetic oligonucleotide
accactgttttcctaatttt

SEQ ID NO: 221 - DNA, 20 bp, Artificial sequence
  Synthetic oligonucleotide
aaccactgttttcctaattt

SEQ ID NO: 222 - DNA, 20 bp, Artificial sequence
  Synthetic oligonucleotide
agttaaaccactgttttcct

SEQ ID NO: 223 - DNA, 20 bp, Artificial sequence
  Synthetic oligonucleotide
aagttaaaccactgttttcc

SEQ ID NO: 224 - DNA, 20 bp, Artificial sequence
  Synthetic oligonucleotide
tcaagttaaaccactgtttt

SEQ ID NO: 225 - DNA, 20 bp, Artificial sequence
  Synthetic oligonucleotide
ttcaagttaaaccactgttt

SEQ ID NO: 226 - DNA, 20 bp, Artificial sequence
  Synthetic oligonucleotide
aattcaagttaaaccactgt

SEQ ID NO: 227 - DNA, 20 bp, Artificial sequence
  Synthetic oligonucleotide
gagaattcaagttaaaccac

SEQ ID NO: 228 - DNA, 20 bp, Artificial sequence
  Synthetic oligonucleotide
gtcaagagagaattcaagtt

SEQ ID NO: 229 - DNA, 20 bp, Artificial sequence
  Synthetic oligonucleotide
tctggacccgtcaagagaga

SEQ ID NO: 230 - DNA, 20 bp, Artificial sequence
  Synthetic oligonucleotide
agatatgtatctgatattaa

SEQ ID NO: 231 - DNA, 20 bp, Artificial sequence
  Synthetic oligonucleotide
aagtgcaagatatgtatctg

SEQ ID NO: 232 - DNA, 20 bp, Artificial sequence
  Synthetic oligonucleotide
aaagtgcaagatatgtatct

SEQ ID NO: 233 - DNA, 20 bp, Artificial sequence
  Synthetic oligonucleotide
aaaagtgcaagatatgtatc

SEQ ID NO: 234 - DNA, 20 bp, Artificial sequence
  Synthetic oligonucleotide
ccaagaaaagtgcaagatat

SEQ ID NO: 235 - DNA, 20 bp, Artificial sequence
  Synthetic oligonucleotide
tgagccaagaaaagtgcaag

SEQ ID NO: 236 - DNA, 20 bp, Artificial sequence
  Synthetic oligonucleotide
ttgagccaagaaaagtgcaa

SEQ ID NO: 237 - DNA, 20 bp, Artificial sequence
  Synthetic oligonucleotide
taattgagccaagaaaagtg

SEQ ID NO: 238 - DNA, 20 bp, Artificial sequence
  Synthetic oligonucleotide
tgtaattgagccaagaaaag

SEQ ID NO: 239 - DNA, 20 bp, Artificial sequence
  Synthetic oligonucleotide
cctgttgtaattgagccaag

SEQ ID NO: 240 - DNA, 20 bp, Artificial sequence
  Synthetic oligonucleotide
aataaccttcctgttgtaat

SEQ ID NO: 241 - DNA, 20 bp, Artificial sequence
  Synthetic oligonucleotide
gaataaccttcctgttgtaa

SEQ ID NO: 242 - DNA, 20 bp, Artificial sequence
  Synthetic oligonucleotide
agaataaccttcctgttgta

SEQ ID NO: 243 - DNA, 20 bp, Artificial sequence
  Synthetic oligonucleotide
tagaataaccttcctgttgt

SEQ ID NO: 244 - DNA, 20 bp, Artificial sequence
  Synthetic oligonucleotide
atagaataaccttcctgttg

SEQ ID NO: 245 - DNA, 20 bp, Artificial sequence
  Synthetic oligonucleotide
tatagaataaccttcctgtt

SEQ ID NO: 246 - DNA, 20 bp, Artificial sequence
  Synthetic oligonucleotide
atatagaataaccttcctgt

SEQ ID NO: 247 - DNA, 20 bp, Artificial sequence
  Synthetic oligonucleotide
aaatatagaataaccttcct

SEQ ID NO: 248 - DNA, 20 bp, Artificial sequence
  Synthetic oligonucleotide
caaatatagaataaccttcc

SEQ ID NO: 249 - DNA, 20 bp, Artificial sequence
  Synthetic oligonucleotide
acaaatatagaataaccttc

SEQ ID NO: 250 - DNA, 20 bp, Artificial sequence
  Synthetic oligonucleotide
taacgacaaatatagaataa

SEQ ID NO: 251 - DNA, 20 bp, Artificial sequence
  Synthetic oligonucleotide
gcagatcacccttaacgaca

SEQ ID NO: 252 - DNA, 20 bp, Artificial sequence
  Synthetic oligonucleotide
ctggcagatcacccttaacg

SEQ ID NO: 253 - DNA, 20 bp, Artificial sequence
  Synthetic oligonucleotide
atctggcagatcacccttaa

SEQ ID NO: 254 - DNA, 20 bp, Artificial sequence
  Synthetic oligonucleotide
aatctggcagatcaccctta

SEQ ID NO: 255 - DNA, 20 bp, Artificial sequence
  Synthetic oligonucleotide
caatctggcagatcaccctt

SEQ ID NO: 256 - DNA, 20 bp, Artificial sequence
  Synthetic oligonucleotide
gcaatctggcagatcaccct

SEQ ID NO: 257 - DNA, 20 bp, Artificial sequence
  Synthetic oligonucleotide
cgcaatctggcagatcaccc

SEQ ID NO: 258 - DNA, 20 bp, Artificial sequence
  Synthetic oligonucleotide
tcgcaatctggcagatcacc

SEQ ID NO: 259 - DNA, 20 bp, Artificial sequence
  Synthetic oligonucleotide
ttcgcaatctggcagatcac

SEQ ID NO: 260 - DNA, 20 bp, Artificial sequence
  Synthetic oligonucleotide
gcttcgcaatctggcagatc

SEQ ID NO: 261 - DNA, 20 bp, Artificial sequence
  Synthetic oligonucleotide
ttcttctccaataagttttg

SEQ ID NO: 262 - DNA, 20 bp, Artificial sequence
  Synthetic oligonucleotide
ctaattcttctccaataagt

SEQ ID NO: 263 - DNA, 20 bp, Artificial sequence
  Synthetic oligonucleotide
gtgctaattcttctccaata

SEQ ID NO: 264 - DNA, 20 bp, Artificial sequence
  Synthetic oligonucleotide
ttgtgctaattcttctccaa

SEQ ID NO: 265 - DNA, 20 bp, Artificial sequence
  Synthetic oligonucleotide
gttgtgctaattcttctcca

SEQ ID NO: 266 - DNA, 20 bp, Artificial sequence
  Synthetic oligonucleotide
ggtctgttttatggactctt

SEQ ID NO: 267 - DNA, 20 bp, Artificial sequence
  Synthetic oligonucleotide
caggtctgttttatggactc

SEQ ID NO: 268 - DNA, 20 bp, Artificial sequence
  Synthetic oligonucleotide
ccaggtctgttttatggact

SEQ ID NO: 269 - DNA, 20 bp, Artificial sequence
  Synthetic oligonucleotide
tcatttgcttctaacactcg

SEQ ID NO: 270 - DNA, 20 bp, Artificial sequence
  Synthetic oligonucleotide
agccatcatttgcttctaac

SEQ ID NO: 271 - DNA, 20 bp, Artificial sequence
  Synthetic oligonucleotide
ttcctgagccatcatttgct

SEQ ID NO: 272 - DNA, 20 bp, Artificial sequence
  Synthetic oligonucleotide
attcctgagccatcatttgc

SEQ ID NO: 273 - DNA, 20 bp, Artificial sequence
  Synthetic oligonucleotide
cattcctgagccatcatttg

SEQ ID NO: 274 - DNA, 20 bp, Artificial sequence
  Synthetic oligonucleotide
tctaacattcctgagccatc

SEQ ID NO: 275 - DNA, 20 bp, Artificial sequence
  Synthetic oligonucleotide
tgcaaatcctcctcatcttc

SEQ ID NO: 276 - DNA, 20 bp, Artificial sequence
  Synthetic oligonucleotide
ctgcaaatcctcctcatctt

SEQ ID NO: 277 - DNA, 20 bp, Artificial sequence
  Synthetic oligonucleotide
tctgcaaatcctcctcatct

SEQ ID NO: 278 - DNA, 20 bp, Artificial sequence
  Synthetic oligonucleotide
ctctgcaaatcctcctcatc

SEQ ID NO: 279 - DNA, 20 bp, Artificial sequence
  Synthetic oligonucleotide
cctctgcaaatcctcctcat

SEQ ID NO: 280 - DNA, 20 bp, Artificial sequence
  Synthetic oligonucleotide
gccctctgcaaatcctcctc

SEQ ID NO: 281 - DNA, 20 bp, Artificial sequence
  Synthetic oligonucleotide
tgccagagccctctgcaaat

SEQ ID NO: 282 - DNA, 20 bp, Artificial sequence
  Synthetic oligonucleotide
agtgccagagccctctgcaa

SEQ ID NO: 283 - DNA, 20 bp, Artificial sequence
  Synthetic oligonucleotide
cgacttagtgccagagccct

SEQ ID NO: 284 - DNA, 20 bp, Artificial sequence
  Synthetic oligonucleotide
ggcgacttagtgccagagcc

SEQ ID NO: 285 - DNA, 20 bp, Artificial sequence
  Synthetic oligonucleotide
ttcttggcgacttagtgcca

SEQ ID NO: 286 - DNA, 20 bp, Artificial sequence
  Synthetic oligonucleotide
catgtcaatttcttggcgac

SEQ ID NO: 287 - DNA, 20 bp, Artificial sequence
  Synthetic oligonucleotide
ccatgtcaatttcttggcga

SEQ ID NO: 288 - DNA, 20 bp, Artificial sequence
  Synthetic oligonucleotide
cctcatcttccatgtcaatt

SEQ ID NO: 289 - DNA, 20 bp, Artificial sequence
  Synthetic oligonucleotide
ttcctcatcttccatgtcaa

SEQ ID NO: 290 - DNA, 20 bp, Artificial sequence
  Synthetic oligonucleotide
cttcctcatcttccatgtca

SEQ ID NO: 291 - DNA, 20 bp, Artificial sequence
  Synthetic oligonucleotide
ctgcttcctcatcttccatg

SEQ ID NO: 292 - DNA, 20 bp, Artificial sequence
  Synthetic oligonucleotide
tctgcttcctcatcttccat

SEQ ID NO: 293 - DNA, 20 bp, Artificial sequence
  Synthetic oligonucleotide
atctgcttcctcatcttcca

SEQ ID NO: 294 - DNA, 20 bp, Artificial sequence
  Synthetic oligonucleotide
gatctgcttcctcatcttcc

SEQ ID NO: 295 - DNA, 20 bp, Artificial sequence
  Synthetic oligonucleotide
agatctgcttcctcatcttc

SEQ ID NO: 296 - DNA, 20 bp, Artificial sequence
  Synthetic oligonucleotide
agctgaatagccctgcggag

SEQ ID NO: 297 - DNA, 20 bp, Artificial sequence
  Synthetic oligonucleotide
accttgcatacttagctgaa

SEQ ID NO: 298 - DNA, 20 bp, Artificial sequence
  Synthetic oligonucleotide
ggaactaccttgcatactta

SEQ ID NO: 299 - DNA, 20 bp, Artificial sequence
  Synthetic oligonucleotide
tctggaactaccttgcatac

SEQ ID NO: 300 - DNA, 20 bp, Artificial sequence
  Synthetic oligonucleotide
tttctggaactaccttgcat

SEQ ID NO: 301 - DNA, 20 bp, Artificial sequence
  Synthetic oligonucleotide
atttgtacctgatgtctgtg

SEQ ID NO: 302 - DNA, 20 bp, Artificial sequence
  Synthetic oligonucleotide
agatttgtacctgatgtctg

SEQ ID NO: 303 - DNA, 20 bp, Artificial sequence
  Synthetic oligonucleotide
gaagtaagatttgtacctga

SEQ ID NO: 304 - DNA, 20 bp, Artificial sequence
  Synthetic oligonucleotide
ctgaagtaagatttgtacct

SEQ ID NO: 305 - DNA, 20 bp, Artificial sequence
  Synthetic oligonucleotide
tctgaagtaagatttgtacc

SEQ ID NO: 306 - DNA, 20 bp, Artificial sequence
  Synthetic oligonucleotide
cgtctcttccgaagctcttc

SEQ ID NO: 307 - DNA, 20 bp, Artificial sequence
  Synthetic oligonucleotide
ctgtttttcaaagtaggctt

SEQ ID NO: 308 - DNA, 20 bp, Artificial sequence
  Synthetic oligonucleotide
gctgtttttcaaagtaggct

SEQ ID NO: 309 - DNA, 20 bp, Artificial sequence
  Synthetic oligonucleotide
tgctgtttttcaaagtaggc

SEQ ID NO: 310 - DNA, 20 bp, Artificial sequence
  Synthetic oligonucleotide
ctgctgtttttcaaagtagg

SEQ ID NO: 311 - DNA, 20 bp, Artificial sequence
  Synthetic oligonucleotide
gctgctgtttttcaaagtag

SEQ ID NO: 312 - DNA, 20 bp, Artificial sequence
  Synthetic oligonucleotide
tgctgctgtttttcaaagta

SEQ ID NO: 313 - DNA, 20 bp, Artificial sequence
  Synthetic oligonucleotide
gttttcaaatcatttctgac

SEQ ID NO: 314 - DNA, 20 bp, Artificial sequence
  Synthetic oligonucleotide
tgttttcaaatcatttctga

SEQ ID NO: 315 - DNA, 20 bp, Artificial sequence
  Synthetic oligonucleotide
ctgttttcaaatcatttctg

SEQ ID NO: 316 - DNA, 20 bp, Artificial sequence
  Synthetic oligonucleotide
ccttctgttttcaaatcatt

SEQ ID NO: 317 - DNA, 20 bp, Artificial sequence
  Synthetic oligonucleotide
tccttctgttttcaaatcat

SEQ ID NO: 318 - DNA, 20 bp, Artificial sequence
  Synthetic oligonucleotide
aaaggtattatttttttcct

SEQ ID NO: 319 - DNA, 20 bp, Artificial sequence
  Synthetic oligonucleotide
taaaggtattatttttttcc

SEQ ID NO: 320 - DNA, 20 bp, Artificial sequence
  Synthetic oligonucleotide
ttaaaggtattatttttttc

SEQ ID NO: 321 - DNA, 20 bp, Artificial sequence
  Synthetic oligonucleotide
gtatgaatatctaaattatt

SEQ ID NO: 322 - DNA, 20 bp, Artificial sequence
  Synthetic oligonucleotide
ggaaagtatgaatatctaaa

SEQ ID NO: 323 - DNA, 20 bp, Artificial sequence
  Synthetic oligonucleotide
tgttggaaagtatgaatatc

SEQ ID NO: 324 - DNA, 20 bp, Artificial sequence
  Synthetic oligonucleotide
aagtggaccctatgctgtaa

SEQ ID NO: 325 - DNA, 20 bp, Artificial sequence
  Synthetic oligonucleotide
aaagtggaccctatgctgta

SEQ ID NO: 326 - DNA, 20 bp, Artificial sequence
  Synthetic oligonucleotide
caaagtggaccctatgctgt

SEQ ID NO: 327 - DNA, 20 bp, Artificial sequence
  Synthetic oligonucleotide
acacattaccaaagtggacc

SEQ ID NO: 328 - DNA, 20 bp, Artificial sequence
  Synthetic oligonucleotide
gacacattaccaaagtggac

SEQ ID NO: 329 - DNA, 20 bp, Artificial sequence
  Synthetic oligonucleotide
ttgacacattaccaaagtgg

SEQ ID NO: 330 - DNA, 20 bp, Artificial sequence
  Synthetic oligonucleotide
tctttgacacattaccaaag

SEQ ID NO: 331 - DNA, 20 bp, Artificial sequence
  Synthetic oligonucleotide
ctctttgacacattaccaaa

SEQ ID NO: 332 - DNA, 20 bp, Artificial sequence
  Synthetic oligonucleotide
tctctttgacacattaccaa

SEQ ID NO: 333 - DNA, 20 bp, Artificial sequence
  Synthetic oligonucleotide
catctctttgacacattacc

SEQ ID NO: 334 - DNA, 20 bp, Artificial sequence
  Synthetic oligonucleotide
ctcatctctttgacacatta

SEQ ID NO: 335 - DNA, 20 bp, Artificial sequence
  Synthetic oligonucleotide
ttcctcatctctttgacaca

SEQ ID NO: 336 - DNA, 20 bp, Artificial sequence
  Synthetic oligonucleotide
cttatttcctcatctctttg

SEQ ID NO: 337 - DNA, 20 bp, Artificial sequence
  Synthetic oligonucleotide
agtcttatttcctcatctct

SEQ ID NO: 338 - DNA, 20 bp, Artificial sequence
  Synthetic oligonucleotide
aagtcttatttcctcatctc

SEQ ID NO: 339 - DNA, 20 bp, Artificial sequence
  Synthetic oligonucleotide
aaagtcttatttcctcatct

SEQ ID NO: 340 - DNA, 20 bp, Artificial sequence
  Synthetic oligonucleotide
aaaagtcttatttcctcatc

SEQ ID NO: 341 - DNA, 20 bp, Artificial sequence
  Synthetic oligonucleotide
ttatttagtcctacaaccga

SEQ ID NO: 342 - DNA, 20 bp, Artificial sequence
  Synthetic oligonucleotide
atcattatttagtcctacaa

SEQ ID NO: 343 - DNA, 20 bp, Artificial sequence
  Synthetic oligonucleotide
aagatcattatttagtccta

SEQ ID NO: 344 - DNA, 20 bp, Artificial sequence
  Synthetic oligonucleotide
tggaagatcattatttagtc

SEQ ID NO: 345 - DNA, 20 bp, Artificial sequence
  Synthetic oligonucleotide
ttggaagatcattatttagt

SEQ ID NO: 346 - DNA, 20 bp, Artificial sequence
  Synthetic oligonucleotide
tttggaagatcattatttag

SEQ ID NO: 347 - DNA, 20 bp, Artificial sequence
  Synthetic oligonucleotide
tatttggaagatcattattt

SEQ ID NO: 348 - DNA, 20 bp, Artificial sequence
  Synthetic oligonucleotide
atatttggaagatcattatt

SEQ ID NO: 349 - DNA, 20 bp, Artificial sequence
  Synthetic oligonucleotide
ctttggctaatatttggaag

SEQ ID NO: 350 - DNA, 20 bp, Artificial sequence
  Synthetic oligonucleotide
tctttggctaatatttggaa

SEQ ID NO: 351 - DNA, 20 bp, Artificial sequence
  Synthetic oligonucleotide
ctctttggctaatatttgga

SEQ ID NO: 352 - DNA, 20 bp, Artificial sequence
  Synthetic oligonucleotide
ttgctgaatgcctctttggc

SEQ ID NO: 353 - DNA, 20 bp, Artificial sequence
  Synthetic oligonucleotide
ttgcacactcaaaaaagaaa

SEQ ID NO: 354 - DNA, 20 bp, Artificial sequence
  Synthetic oligonucleotide
tattgcacactcaaaaaaga

SEQ ID NO: 355 - DNA, 20 bp, Artificial sequence
  Synthetic oligonucleotide
atattgcacactcaaaaaag

SEQ ID NO: 356 - DNA, 20 bp, Artificial sequence
  Synthetic oligonucleotide
aagatccaagaaaaatgccc

SEQ ID NO: 357 - DNA, 20 bp, Artificial sequence
  Synthetic oligonucleotide
tgcaaaaagatccaagaaaa

SEQ ID NO: 358 - DNA, 20 bp, Artificial sequence
  Synthetic oligonucleotide
ctgcaaaaagatccaagaaa

SEQ ID NO: 359 - DNA, 20 bp, Artificial sequence
  Synthetic oligonucleotide
tctgcaaaaagatccaagaa

SEQ ID NO: 360 - DNA, 20 bp, Artificial sequence
  Synthetic oligonucleotide
agaaaacaaactatatggaa

SEQ ID NO: 361 - DNA, 20 bp, Artificial sequence
  Synthetic oligonucleotide
aatgaaagccactattacat

SEQ ID NO: 362 - DNA, 20 bp, Artificial sequence
  Synthetic oligonucleotide
gaaatgaaagccactattac

SEQ ID NO: 363 - DNA, 20 bp, Artificial sequence
  Synthetic oligonucleotide
atttggttaataagaaatga

SEQ ID NO: 364 - DNA, 20 bp, Artificial sequence
  Synthetic oligonucleotide
taatttggttaataagaaat

SEQ ID NO: 365 - DNA, 20 bp, Artificial sequence
  Synthetic oligonucleotide
tgaaaggttaatttggttaa

SEQ ID NO: 366 - DNA, 20 bp, Artificial sequence
  Synthetic oligonucleotide
ctgaaaggttaatttggtta

SEQ ID NO: 367 - DNA, 20 bp, Artificial sequence
  Synthetic oligonucleotide
tactttcctgaaaggttaat

SEQ ID NO: 368 - DNA, 20 bp, Artificial sequence
  Synthetic oligonucleotide
agatactttcctgaaaggtt

SEQ ID NO: 369 - DNA, 20 bp, Artificial sequence
  Synthetic oligonucleotide
gagatactttcctgaaaggt

SEQ ID NO: 370 - DNA, 20 bp, Artificial sequence
  Synthetic oligonucleotide
agagatactttcctgaaagg

SEQ ID NO: 371 - DNA, 20 bp, Artificial sequence
  Synthetic oligonucleotide
actattatcaacatcaggaa

SEQ ID NO: 372 - DNA, 20 bp, Artificial sequence
  Synthetic oligonucleotide
gaaccattactattatcaac

SEQ ID NO: 373 - DNA, 20 bp, Artificial sequence
  Synthetic oligonucleotide
agaaccattactattatcaa

SEQ ID NO: 374 - DNA, 20 bp, Artificial sequence
  Synthetic oligonucleotide
tagaaccattactattatca

SEQ ID NO: 375 - DNA, 20 bp, Artificial sequence
  Synthetic oligonucleotide
tctagaaccattactattat

SEQ ID NO: 376 - DNA, 20 bp, Artificial sequence
  Synthetic oligonucleotide
ttctagaaccattactatta

SEQ ID NO: 377 - DNA, 20 bp, Artificial sequence
  Synthetic oligonucleotide
cttctagaaccattactatt

SEQ ID NO: 378 - DNA, 20 bp, Artificial sequence
  Synthetic oligonucleotide
ccttctagaaccattactat

SEQ ID NO: 379 - DNA, 20 bp, Artificial sequence
  Synthetic oligonucleotide
tccttctagaaccattacta

SEQ ID NO: 380 - DNA, 20 bp, Artificial sequence
  Synthetic oligonucleotide
acacaagaaaacactggagc

SEQ ID NO: 381 - DNA, 20 bp, Artificial sequence
  Synthetic oligonucleotide
caacacaagaaaacactgga

SEQ ID NO: 382 - DNA, 20 bp, Artificial sequence
  Synthetic oligonucleotide
tcagagaaaacaacacaaga

SEQ ID NO: 383 - DNA, 20 bp, Artificial sequence
  Synthetic oligonucleotide
aatgaaaaccaggtagcaga

SEQ ID NO: 384 - DNA, 20 bp, Artificial sequence
  Synthetic oligonucleotide
ataatgaaaaccaggtagca

SEQ ID NO: 385 - DNA, 20 bp, Artificial sequence
  Synthetic oligonucleotide
gaaaataatgaaaaccaggt

SEQ ID NO: 386 - DNA, 20 bp, Artificial sequence
  Synthetic oligonucleotide
gtgggaaaataatgaaaacc

SEQ ID NO: 387 - DNA, 20 bp, Artificial sequence
  Synthetic oligonucleotide
tgtgggaaaataatgaaaac

SEQ ID NO: 388 - DNA, 20 bp, Artificial sequence
  Synthetic oligonucleotide
ttgtgggaaaataatgaaaa

SEQ ID NO: 389 - DNA, 20 bp, Artificial sequence
  Synthetic oligonucleotide
ttcaaaagaattgtgggaaa

SEQ ID NO: 390 - DNA, 20 bp, Artificial sequence
  Synthetic oligonucleotide
ctttcaaaagaattgtggga

SEQ ID NO: 391 - DNA, 20 bp, Artificial sequence
  Synthetic oligonucleotide
tctttcaaaagaattgtggg

SEQ ID NO: 392 - DNA, 20 bp, Artificial sequence
  Synthetic oligonucleotide
catctttcaaaagaattgtg

SEQ ID NO: 393 - DNA, 20 bp, Artificial sequence
  Synthetic oligonucleotide
ccatctttcaaaagaattgt

SEQ ID NO: 394 - DNA, 20 bp, Artificial sequence
  Synthetic oligonucleotide
accatctttcaaaagaattg

SEQ ID NO: 395 - DNA, 20 bp, Artificial sequence
  Synthetic oligonucleotide
gattaccatctttcaaaaga

SEQ ID NO: 396 - DNA, 20 bp, Artificial sequence
  Synthetic oligonucleotide
aaagattaccatctttcaaa

SEQ ID NO: 397 - DNA, 20 bp, Artificial sequence
  Synthetic oligonucleotide
gaaaagattaccatctttca

SEQ ID NO: 398 - DNA, 20 bp, Artificial sequence
  Synthetic oligonucleotide
cagaaaagattaccatcttt

SEQ ID NO: 399 - DNA, 20 bp, Artificial sequence
  Synthetic oligonucleotide
tcagaaaagattaccatctt

SEQ ID NO: 400 - DNA, 20 bp, Artificial sequence
  Synthetic oligonucleotide
ctcagaaaagattaccatct

SEQ ID NO: 401 - DNA, 20 bp, Artificial sequence
  Synthetic oligonucleotide
cctcagaaaagattaccatc

SEQ ID NO: 402 - DNA, 20 bp, Artificial sequence
  Synthetic oligonucleotide
acgctaaacctcagaaaaga

SEQ ID NO: 403 - DNA, 20 bp, Artificial sequence
  Synthetic oligonucleotide
catgaaataatgatcccatc

SEQ ID NO: 404 - DNA, 20 bp, Artificial sequence
  Synthetic oligonucleotide
tcatgaaataatgatcccat

SEQ ID NO: 405 - DNA, 20 bp, Artificial sequence
  Synthetic oligonucleotide
gtcatgaaataatgatccca

SEQ ID NO: 406 - DNA, 20 bp, Artificial sequence
  Synthetic oligonucleotide
agtcatgaaataatgatccc

SEQ ID NO: 407 - DNA, 20 bp, Artificial sequence
  Synthetic oligonucleotide
cagtcatgaaataatgatcc

SEQ ID NO: 408 - DNA, 20 bp, Artificial sequence
  Synthetic oligonucleotide
ccagtcatgaaataatgatc

SEQ ID NO: 409 - DNA, 20 bp, Artificial sequence
  Synthetic oligonucleotide
accagtcatgaaataatgat

SEQ ID NO: 410 - DNA, 20 bp, Artificial sequence
  Synthetic oligonucleotide
taggaacgcaccagtcatga

SEQ ID NO: 411 - DNA, 20 bp, Artificial sequence
  Synthetic oligonucleotide
tttaggaacgcaccagtcat

SEQ ID NO: 412 - DNA, 20 bp, Artificial sequence
  Synthetic oligonucleotide
gtttaggaacgcaccagtca

SEQ ID NO: 413 - DNA, 20 bp, Artificial sequence
  Synthetic oligonucleotide
agtttaggaacgcaccagtc

SEQ ID NO: 414 - DNA, 20 bp, Artificial sequence
  Synthetic oligonucleotide
gagtttaggaacgcaccagt

SEQ ID NO: 415 - DNA, 20 bp, Artificial sequence
  Synthetic oligonucleotide
agagtttaggaacgcaccag

SEQ ID NO: 416 - DNA, 20 bp, Artificial sequence
  Synthetic oligonucleotide
cagagtttaggaacgcacca

SEQ ID NO: 417 - DNA, 20 bp, Artificial sequence
  Synthetic oligonucleotide
tcagagtttaggaacgcacc

SEQ ID NO: 418 - DNA, 20 bp, Artificial sequence
  Synthetic oligonucleotide
tttcagagtttaggaacgca

SEQ ID NO: 419 - DNA, 20 bp, Artificial sequence
  Synthetic oligonucleotide
ggctgatttcagagtttagg

SEQ ID NO: 420 - DNA, 20 bp, Artificial sequence
  Synthetic oligonucleotide
catttattctcaagtacttg

SEQ ID NO: 421 - DNA, 20 bp, Artificial sequence
  Synthetic oligonucleotide
tcatttattctcaagtactt

SEQ ID NO: 422 - DNA, 20 bp, Artificial sequence
  Synthetic oligonucleotide
ctcatttattctcaagtact

SEQ ID NO: 423 - DNA, 20 bp, Artificial sequence
  Synthetic oligonucleotide
gctcatttattctcaagtac

SEQ ID NO: 424 - DNA, 20 bp, Artificial sequence
  Synthetic oligonucleotide
aaaatgctcatttattctca

SEQ ID NO: 425 - DNA, 20 bp, Artificial sequence
  Synthetic oligonucleotide
gcacatgctcacacatttta

SEQ ID NO: 426 - DNA, 20 bp, Artificial sequence
  Synthetic oligonucleotide
gatataagtgaaaagacatt

SEQ ID NO: 427 - DNA, 20 bp, Artificial sequence
  Synthetic oligonucleotide
gggttgcaacaaagctgtaa

SEQ ID NO: 428 - DNA, 20 bp, Artificial sequence
  Synthetic oligonucleotide
aaggaaaaaataaggcgcag

SEQ ID NO: 429 - DNA, 20 bp, Artificial sequence
  Synthetic oligonucleotide
gaaaggaaaaaataaggcgc

SEQ ID NO: 430 - DNA, 20 bp, Artificial sequence
  Synthetic oligonucleotide
cctagttttctcaattggag

SEQ ID NO: 431 - DNA, 20 bp, Artificial sequence
  Synthetic oligonucleotide
ctcctagttttctcaattgg

SEQ ID NO: 432 - DNA, 20 bp, Artificial sequence
  Synthetic oligonucleotide
cttctcctagttttctcaat

SEQ ID NO: 433 - DNA, 20 bp, Artificial sequence
  Synthetic oligonucleotide
ctatgcttctcctagttttc

SEQ ID NO: 434 - DNA, 20 bp, Artificial sequence
  Synthetic oligonucleotide
actatgcttctcctagtttt

SEQ ID NO: 435 - DNA, 20 bp, Artificial sequence
  Synthetic oligonucleotide
gcctgcatactatgcttctc

SEQ ID NO: 436 - DNA, 20 bp, Artificial sequence
  Synthetic oligonucleotide
tgcctgcatactatgcttct

SEQ ID NO: 437 - DNA, 20 bp, Artificial sequence
  Synthetic oligonucleotide
gagacttgcctgcatactat

SEQ ID NO: 438 - DNA, 20 bp, Artificial sequence
  Synthetic oligonucleotide
gtcttctaacagaaggagac

SEQ ID NO: 439 - DNA, 20 bp, Artificial sequence
  Synthetic oligonucleotide
agtcttctaacagaaggaga

SEQ ID NO: 440 - DNA, 20 bp, Artificial sequence
  Synthetic oligonucleotide
tagtcttctaacagaaggag

SEQ ID NO: 441 - DNA, 20 bp, Artificial sequence
  Synthetic oligonucleotide
ttagtcttctaacagaagga

SEQ ID NO: 442 - DNA, 20 bp, Artificial sequence
  Synthetic oligonucleotide
tttagtcttctaacagaagg

SEQ ID NO: 443 - DNA, 20 bp, Artificial sequence
  Synthetic oligonucleotide
gtttagtcttctaacagaag

SEQ ID NO: 444 - DNA, 20 bp, Artificial sequence
  Synthetic oligonucleotide
atgtttagtcttctaacaga

SEQ ID NO: 445 - DNA, 20 bp, Artificial sequence
  Synthetic oligonucleotide
gtatgtttagtcttctaaca

SEQ ID NO: 446 - DNA, 20 bp, Artificial sequence
  Synthetic oligonucleotide
ggccaaatttcatgtatcat

SEQ ID NO: 447 - DNA, 20 bp, Artificial sequence
  Synthetic oligonucleotide
aaggccaaatttcatgtatc

SEQ ID NO: 448 - DNA, 20 bp, Artificial sequence
  Synthetic oligonucleotide
gaaggccaaatttcatgtat

SEQ ID NO: 449 - DNA, 20 bp, Artificial sequence
  Synthetic oligonucleotide
attgaaggccaaatttcatg

SEQ ID NO: 450 - DNA, 20 bp, Artificial sequence
  Synthetic oligonucleotide
ctattaaaattgaaggccaa

SEQ ID NO: 451 - DNA, 20 bp, Artificial sequence
  Synthetic oligonucleotide
gctattaaaattgaaggcca

SEQ ID NO: 452 - DNA, 20 bp, Artificial sequence
  Synthetic oligonucleotide
ctgctattaaaattgaaggc

SEQ ID NO: 453 - DNA, 20 bp, Artificial sequence
  Synthetic oligonucleotide
actgctattaaaattgaagg

SEQ ID NO: 454 - DNA, 20 bp, Artificial sequence
  Synthetic oligonucleotide
aactgctattaaaattgaag

SEQ ID NO: 455 - DNA, 20 bp, Artificial sequence
  Synthetic oligonucleotide
aaactgctattaaaattgaa

SEQ ID NO: 456 - DNA, 20 bp, Artificial sequence
  Synthetic oligonucleotide
aaaactgctattaaaattga

SEQ ID NO: 457 - DNA, 20 bp, Artificial sequence
  Synthetic oligonucleotide
catgactcaactgtaaagag

SEQ ID NO: 458 - DNA, 20 bp, Artificial sequence
  Synthetic oligonucleotide
tacctactaaaagatgtgaa

SEQ ID NO: 459 - DNA, 20 bp, Artificial sequence
  Synthetic oligonucleotide
atacctactaaaagatgtga

SEQ ID NO: 460 - DNA, 20 bp, Artificial sequence
  Synthetic oligonucleotide
tatacctactaaaagatgtg

SEQ ID NO: 461 - DNA, 20 bp, Artificial sequence
  Synthetic oligonucleotide
ctatacctactaaaagatgt

SEQ ID NO: 462 - DNA, 20 bp, Artificial sequence
  Synthetic oligonucleotide
gctatacctactaaaagatg

SEQ ID NO: 463 - DNA, 20 bp, Artificial sequence
  Synthetic oligonucleotide
agctatacctactaaaagat

SEQ ID NO: 464 - DNA, 20 bp, Artificial sequence
  Synthetic oligonucleotide
aagctatacctactaaaaga

SEQ ID NO: 465 - DNA, 20 bp, Artificial sequence
  Synthetic oligonucleotide
acaagctatacctactaaaa

SEQ ID NO: 466 - DNA, 20 bp, Artificial sequence
  Synthetic oligonucleotide
tgacaagctatacctactaa

SEQ ID NO: 467 - DNA, 20 bp, Artificial sequence
  Synthetic oligonucleotide
tttgacaagctatacctact

SEQ ID NO: 468 - DNA, 20 bp, Artificial sequence
  Synthetic oligonucleotide
atcaccatctttgacaagct

SEQ ID NO: 469 - DNA, 20 bp, Artificial sequence
  Synthetic oligonucleotide
ccagatcaccatctttgaca

SEQ ID NO: 470 - DNA, 20 bp, Artificial sequence
  Synthetic oligonucleotide
ttccagatcaccatctttga

SEQ ID NO: 471 - DNA, 20 bp, Artificial sequence
  Synthetic oligonucleotide
gttccagatcaccatctttg

SEQ ID NO: 472 - DNA, 20 bp, Artificial sequence
  Synthetic oligonucleotide
tgttccagatcaccatcttt

SEQ ID NO: 473 - DNA, 20 bp, Artificial sequence
  Synthetic oligonucleotide
atgttccagatcaccatctt

SEQ ID NO: 474 - DNA, 20 bp, Artificial sequence
  Synthetic oligonucleotide
tcatgttccagatcaccatc

SEQ ID NO: 475 - DNA, 20 bp, Artificial sequence
  Synthetic oligonucleotide
ttcatgttccagatcaccat

SEQ ID NO: 476 - DNA, 20 bp, Artificial sequence
  Synthetic oligonucleotide
tttcatgttccagatcacca

SEQ ID NO: 477 - DNA, 20 bp, Artificial sequence
  Synthetic oligonucleotide
ttttcatgttccagatcacc

SEQ ID NO: 478 - DNA, 20 bp, Artificial sequence
  Synthetic oligonucleotide
aattattttcatgttccaga

SEQ ID NO: 479 - DNA, 20 bp, Artificial sequence
  Synthetic oligonucleotide
attagtaaattattttcatg

SEQ ID NO: 480 - DNA, 20 bp, Artificial sequence
  Synthetic oligonucleotide
acatattttcattagtaaat

SEQ ID NO: 481 - DNA, 20 bp, Artificial sequence
  Synthetic oligonucleotide
aacatattttcattagtaaa

SEQ ID NO: 482 - DNA, 20 bp, Artificial sequence
  Synthetic oligonucleotide
gtataaatttaaacatattt

SEQ ID NO: 483 - DNA, 20 bp, Artificial sequence
  Synthetic oligonucleotide
acagtataaatttaaacata

SEQ ID NO: 484 - DNA, 20 bp, Artificial sequence
  Synthetic oligonucleotide
cacagtataaatttaaacat

SEQ ID NO: 485 - DNA, 20 bp, Artificial sequence
  Synthetic oligonucleotide
tcacagtataaatttaaaca

SEQ ID NO: 486 - DNA, 20 bp, Artificial sequence
  Synthetic oligonucleotide
atcacagtataaatttaaac

SEQ ID NO: 487 - DNA, 20 bp, Artificial sequence
  Synthetic oligonucleotide
aatcacagtataaatttaaa

SEQ ID NO: 488 - DNA, 20 bp, Artificial sequence
  Synthetic oligonucleotide
caaatcacagtataaattta

SEQ ID NO: 489 - DNA, 20 bp, Artificial sequence
  Synthetic oligonucleotide
aagtgtcaaatcacagtata

SEQ ID NO: 490 - DNA, 20 bp, Artificial sequence
  Synthetic oligonucleotide
tgcaagtgtcaaatcacagt

SEQ ID NO: 491 - DNA, 20 bp, Artificial sequence
  Synthetic oligonucleotide
ctatctaaacatgatgcaag

SEQ ID NO: 492 - DNA, 20 bp, Artificial sequence
  Synthetic oligonucleotide
gctatctaaacatgatgcaa

SEQ ID NO: 493 - DNA, 20 bp, Artificial sequence
  Synthetic oligonucleotide
agctatctaaacatgatgca

SEQ ID NO: 494 - DNA, 20 bp, Artificial sequence
  Synthetic oligonucleotide
taagctatctaaacatgatg

SEQ ID NO: 495 - DNA, 20 bp, Artificial sequence
  Synthetic oligonucleotide
ttaagctatctaaacatgat

SEQ ID NO: 496 - DNA, 20 bp, Artificial sequence
  Synthetic oligonucleotide
cttaagctatctaaacatga

SEQ ID NO: 497 - DNA, 20 bp, Artificial sequence
  Synthetic oligonucleotide
tcttaagctatctaaacatg

SEQ ID NO: 498 - DNA, 20 bp, Artificial sequence
  Synthetic oligonucleotide
gttcttaagctatctaaaca

SEQ ID NO: 499 - DNA, 20 bp, Artificial sequence
  Synthetic oligonucleotide
ttatagatccactaagtact

SEQ ID NO: 500 - DNA, 20 bp, Artificial sequence
  Synthetic oligonucleotide
ctttcttatttatagatcca

SEQ ID NO: 501 - DNA, 20 bp, Artificial sequence
  Synthetic oligonucleotide
gactttcttatttatagatc

SEQ ID NO: 502 - DNA, 20 bp, Artificial sequence
  Synthetic oligonucleotide
ttatcaaaactatggacttt

SEQ ID NO: 503 - DNA, 20 bp, Artificial sequence
  Synthetic oligonucleotide
tttatcaaaactatggactt

SEQ ID NO: 504 - DNA, 20 bp, Artificial sequence
  Synthetic oligonucleotide
atttatcaaaactatggact

SEQ ID NO: 505 - DNA, 20 bp, Artificial sequence
  Synthetic oligonucleotide
atatttatcaaaactatgga

SEQ ID NO: 506 - DNA, 20 bp, Artificial sequence
  Synthetic oligonucleotide
aatatttatcaaaactatgg

SEQ ID NO: 507 - DNA, 20 bp, Artificial sequence
  Synthetic oligonucleotide
ttaaagagaatatttatcaa

SEQ ID NO: 508 - DNA, 20 bp, Artificial sequence
  Synthetic oligonucleotide
aattaaagagaatatttatc

SEQ ID NO: 509 - DNA, 20 bp, Artificial sequence
  Synthetic oligonucleotide
catctcaattaaagagaata

SEQ ID NO: 510 - DNA, 20 bp, Artificial sequence
  Synthetic oligonucleotide
gtacatctcaattaaagaga

SEQ ID NO: 511 - DNA, 20 bp, Artificial sequence
  Synthetic oligonucleotide
tcctattgacccagcaagaa

SEQ ID NO: 512 - DNA, 20 bp, Artificial sequence
  Synthetic oligonucleotide
actatcctattgacccagca

SEQ ID NO: 513 - DNA, 20 bp, Artificial sequence
  Synthetic oligonucleotide
tgatactatcctattgaccc

SEQ ID NO: 514 - DNA, 20 bp, Artificial sequence
  Synthetic oligonucleotide
ggttttcaccaaaatgatac

SEQ ID NO: 515 - DNA, 20 bp, Artificial sequence
  Synthetic oligonucleotide
acatcaatttcagagacatg

SEQ ID NO: 516 - DNA, 20 bp, Artificial sequence
  Synthetic oligonucleotide
aacatcaatttcagagacat

SEQ ID NO: 517 - DNA, 20 bp, Artificial sequence
  Synthetic oligonucleotide
aaacatcaatttcagagaca

SEQ ID NO: 518 - DNA, 20 bp, Artificial sequence
  Synthetic oligonucleotide
gaaactaaaacatcaatttc

SEQ ID NO: 519 - DNA, 20 bp, Artificial sequence
  Synthetic oligonucleotide
actgaaactaaaacatcaat

SEQ ID NO: 520 - DNA, 20 bp, Artificial sequence
  Synthetic oligonucleotide
aaagagcttcaaaaggagat

SEQ ID NO: 521 - DNA, 20 bp, Artificial sequence
  Synthetic oligonucleotide
caacattcaaaagagcttca

SEQ ID NO: 522 - DNA, 20 bp, Artificial sequence
  Synthetic oligonucleotide
tcaacattcaaaagagcttc

SEQ ID NO: 523 - DNA, 20 bp, Artificial sequence
  Synthetic oligonucleotide
ttcaacattcaaaagagctt

SEQ ID NO: 524 - DNA, 20 bp, Artificial sequence
  Synthetic oligonucleotide
caattcaacattcaaaagag

SEQ ID NO: 525 - DNA, 20 bp, Artificial sequence
  Synthetic oligonucleotide
acaattcaacattcaaaaga

SEQ ID NO: 526 - DNA, 20 bp, Artificial sequence
  Synthetic oligonucleotide
aacaattcaacattcaaaag

SEQ ID NO: 527 - DNA, 20 bp, Artificial sequence
  Synthetic oligonucleotide
gaacaattcaacattcaaaa

SEQ ID NO: 528 - DNA, 20 bp, Artificial sequence
  Synthetic oligonucleotide
tgaacaattcaacattcaaa

SEQ ID NO: 529 - DNA, 20 bp, Artificial sequence
  Synthetic oligonucleotide
atgaacaattcaacattcaa

SEQ ID NO: 530 - DNA, 20 bp, Artificial sequence
  Synthetic oligonucleotide
tatgaacaattcaacattca

SEQ ID NO: 531 - DNA, 20 bp, Artificial sequence
  Synthetic oligonucleotide
ttatgaacaattcaacattc

SEQ ID NO: 532 - DNA, 20 bp, Artificial sequence
  Synthetic oligonucleotide
gcttatgaacaattcaacat

SEQ ID NO: 533 - DNA, 20 bp, Artificial sequence
  Synthetic oligonucleotide
tttagcttatgaacaattca

SEQ ID NO: 534 - DNA, 20 bp, Artificial sequence
  Synthetic oligonucleotide
tttcttggattttagcttat

SEQ ID NO: 535 - DNA, 20 bp, Artificial sequence
  Synthetic oligonucleotide
agctgaaatttcttggattt

SEQ ID NO: 536 - DNA, 20 bp, Artificial sequence
  Synthetic oligonucleotide
cagctgaaatttcttggatt

SEQ ID NO: 537 - DNA, 20 bp, Artificial sequence
  Synthetic oligonucleotide
tcagctgaaatttcttggat

SEQ ID NO: 538 - DNA, 20 bp, Artificial sequence
  Synthetic oligonucleotide
gtcagctgaaatttcttgga

SEQ ID NO: 539 - DNA, 20 bp, Artificial sequence
  Synthetic oligonucleotide
ttgtcagctgaaatttcttg

SEQ ID NO: 540 - DNA, 20 bp, Artificial sequence
  Synthetic oligonucleotide
agttgtcagctgaaatttct

SEQ ID NO: 541 - DNA, 20 bp, Artificial sequence
  Synthetic oligonucleotide
aagttgtcagctgaaatttc

SEQ ID NO: 542 - DNA, 20 bp, Artificial sequence
  Synthetic oligonucleotide
gaagttgtcagctgaaattt

SEQ ID NO: 543 - DNA, 20 bp, Artificial sequence
  Synthetic oligonucleotide
cgaagttgtcagctgaaatt

SEQ ID NO: 544 - DNA, 20 bp, Artificial sequence
  Synthetic oligonucleotide
tcgaagttgtcagctgaaat

SEQ ID NO: 545 - DNA, 20 bp, Artificial sequence
  Synthetic oligonucleotide
ttcgaagttgtcagctgaaa

SEQ ID NO: 546 - DNA, 20 bp, Artificial sequence
  Synthetic oligonucleotide
tttcgaagttgtcagctgaa

SEQ ID NO: 547 - DNA, 20 bp, Artificial sequence
  Synthetic oligonucleotide
attttcgaagttgtcagctg

SEQ ID NO: 548 - DNA, 20 bp, Artificial sequence
  Synthetic oligonucleotide
tattataattttcgaagttg

SEQ ID NO: 549 - DNA, 20 bp, Artificial sequence
  Synthetic oligonucleotide
catattataattttcgaagt

SEQ ID NO: 550 - DNA, 20 bp, Artificial sequence
  Synthetic oligonucleotide
tataccatattataattttc

SEQ ID NO: 551 - DNA, 20 bp, Artificial sequence
  Synthetic oligonucleotide
ggcaatataccatattataa

SEQ ID NO: 552 - DNA, 20 bp, Artificial sequence
  Synthetic oligonucleotide
agggcaatataccatattat

SEQ ID NO: 553 - DNA, 20 bp, Artificial sequence
  Synthetic oligonucleotide
gagggcaatataccatatta

SEQ ID NO: 554 - DNA, 20 bp, Artificial sequence
  Synthetic oligonucleotide
atcaaaaaactttccctgat

SEQ ID NO: 555 - DNA, 20 bp, Artificial sequence
  Synthetic oligonucleotide
gatcaaaaaactttccctga

SEQ ID NO: 556 - DNA, 20 bp, Artificial sequence
  Synthetic oligonucleotide
agatcaaaaaactttccctg

SEQ ID NO: 557 - DNA, 20 bp, Artificial sequence
  Synthetic oligonucleotide
ctagatcaaaaaactttccc

SEQ ID NO: 558 - DNA, 20 bp, Artificial sequence
  Synthetic oligonucleotide
cctagatcaaaaaactttcc

SEQ ID NO: 559 - DNA, 20 bp, Artificial sequence
  Synthetic oligonucleotide
tcctagatcaaaaaactttc

SEQ ID NO: 560 - DNA, 20 bp, Artificial sequence
  Synthetic oligonucleotide
atcctagatcaaaaaacttt

SEQ ID NO: 561 - DNA, 20 bp, Artificial sequence
  Synthetic oligonucleotide
aatcctagatcaaaaaactt

SEQ ID NO: 562 - DNA, 20 bp, Artificial sequence
  Synthetic oligonucleotide
aaatcctagatcaaaaaact

SEQ ID NO: 563 - DNA, 20 bp, Artificial sequence
  Synthetic oligonucleotide
taaatcctagatcaaaaaac

SEQ ID NO: 564 - DNA, 20 bp, Artificial sequence
  Synthetic oligonucleotide
gcaataaatcctagatcaaa

SEQ ID NO: 565 - DNA, 20 bp, Artificial sequence
  Synthetic oligonucleotide
agcaataaatcctagatcaa

SEQ ID NO: 566 - DNA, 20 bp, Artificial sequence
  Synthetic oligonucleotide
tagcaataaatcctagatca

SEQ ID NO: 567 - DNA, 20 bp, Artificial sequence
  Synthetic oligonucleotide
gttagcaataaatcctagat

SEQ ID NO: 568 - DNA, 20 bp, Artificial sequence
  Synthetic oligonucleotide
aatcataaataaaagatatt

SEQ ID NO: 569 - DNA, 20 bp, Artificial sequence
  Synthetic oligonucleotide
taatcataaataaaagatat

SEQ ID NO: 570 - DNA, 20 bp, Artificial sequence
  Synthetic oligonucleotide
aagctattttataatcataa

SEQ ID NO: 571 - DNA, 20 bp, Artificial sequence
  Synthetic oligonucleotide
aaaagctattttataatcat

SEQ ID NO: 572 - DNA, 20 bp, Artificial sequence
  Synthetic oligonucleotide
cttaaaaaatctgttatatc

SEQ ID NO: 573 - DNA, 20 bp, Artificial sequence
  Synthetic oligonucleotide
gacttaaaaaatctgttata

SEQ ID NO: 574 - DNA, 20 bp, Artificial sequence
  Synthetic oligonucleotide
tgacttaaaaaatctgttat

SEQ ID NO: 575 - DNA, 20 bp, Artificial sequence
  Synthetic oligonucleotide
atgacttaaaaaatctgtta

SEQ ID NO: 576 - DNA, 20 bp, Artificial sequence
  Synthetic oligonucleotide
aatgacttaaaaaatctgtt

SEQ ID NO: 577 - DNA, 20 bp, Artificial sequence
  Synthetic oligonucleotide
taatgacttaaaaaatctgt

SEQ ID NO: 578 - DNA, 20 bp, Artificial sequence
  Synthetic oligonucleotide
gcacaaaataatgacttaaa

SEQ ID NO: 579 - DNA, 20 bp, Artificial sequence
  Synthetic oligonucleotide
ggcacaaaataatgacttaa

SEQ ID NO: 580 - DNA, 20 bp, Artificial sequence
  Synthetic oligonucleotide
tggcacaaaataatgactta

SEQ ID NO: 581 - DNA, 20 bp, Artificial sequence
  Synthetic oligonucleotide
ttggcacaaaataatgactt

SEQ ID NO: 582 - DNA, 20 bp, Artificial sequence
  Synthetic oligonucleotide
gattggcacaaaataatgac

SEQ ID NO: 583 - DNA, 20 bp, Artificial sequence
  Synthetic oligonucleotide
aagggaaacttcagaaaact

SEQ ID NO: 584 - DNA, 20 bp, Artificial sequence
  Synthetic oligonucleotide
taagggaaacttcagaaaac

SEQ ID NO: 585 - DNA, 20 bp, Artificial sequence
  Synthetic oligonucleotide
gtaagggaaacttcagaaaa

SEQ ID NO: 586 - DNA, 20 bp, Artificial sequence
  Synthetic oligonucleotide
tgtaagggaaacttcagaaa

SEQ ID NO: 587 - DNA, 20 bp, Artificial sequence
  Synthetic oligonucleotide
ttagattttaaaataaagct

SEQ ID NO: 588 - DNA, 20 bp, Artificial sequence
  Synthetic oligonucleotide
tttaactattaaaagaaact

SEQ ID NO: 589 - DNA, 20 bp, Artificial sequence
  Synthetic oligonucleotide
ctgaaacatttttaactatt

SEQ ID NO: 590 - DNA, 20 bp, Artificial sequence
  Synthetic oligonucleotide
ataattcttctgaaacattt

SEQ ID NO: 591 - DNA, 20 bp, Artificial sequence
  Synthetic oligonucleotide
ttataattcttctgaaacat

SEQ ID NO: 592 - DNA, 20 bp, Artificial sequence
  Synthetic oligonucleotide
tttataattcttctgaaaca

SEQ ID NO: 593 - DNA, 20 bp, Artificial sequence
  Synthetic oligonucleotide
ttttataattcttctgaaac

SEQ ID NO: 594 - DNA, 20 bp, Artificial sequence
  Synthetic oligonucleotide
gttttataattcttctgaaa

SEQ ID NO: 595 - DNA, 20 bp, Artificial sequence
  Synthetic oligonucleotide
agttttataattcttctgaa

SEQ ID NO: 596 - DNA, 20 bp, Artificial sequence
  Synthetic oligonucleotide
aagttttataattcttctga

SEQ ID NO: 597 - DNA, 20 bp, Artificial sequence
  Synthetic oligonucleotide
taaagttttataattcttct

SEQ ID NO: 598 - DNA, 20 bp, Artificial sequence
  Synthetic oligonucleotide
ttaaagttttataattcttc

SEQ ID NO: 599 - DNA, 20 bp, Artificial sequence
  Synthetic oligonucleotide
gttttaaagttttataattc

SEQ ID NO: 600 - DNA, 20 bp, Artificial sequence
  Synthetic oligonucleotide
ttgcagttttaaagttttat

SEQ ID NO: 601 - DNA, 20 bp, Artificial sequence
  Synthetic oligonucleotide
tttttaaatcttgagggagt

SEQ ID NO: 602 - DNA, 20 bp, Artificial sequence
  Synthetic oligonucleotide
tagctttttaaatcttgagg

SEQ ID NO: 603 - DNA, 20 bp, Artificial sequence
  Synthetic oligonucleotide
ttagctttttaaatcttgag

SEQ ID NO: 604 - DNA, 20 bp, Artificial sequence
  Synthetic oligonucleotide
tttagctttttaaatcttga

SEQ ID NO: 605 - DNA, 20 bp, Artificial sequence
  Synthetic oligonucleotide
atttagctttttaaatcttg

SEQ ID NO: 606 - DNA, 20 bp, Artificial sequence
  Synthetic oligonucleotide
tatttagctttttaaatctt

SEQ ID NO: 607 - DNA, 20 bp, Artificial sequence
  Synthetic oligonucleotide
tcttaaaatatttagctttt

SEQ ID NO: 608 - DNA, 20 bp, Artificial sequence
  Synthetic oligonucleotide
gtcttaaaatatttagcttt

SEQ ID NO: 609 - DNA, 20 bp, Artificial sequence
  Synthetic oligonucleotide
agtcttaaaatatttagctt

SEQ ID NO: 610 - DNA, 20 bp, Artificial sequence
  Synthetic oligonucleotide
cagtcttaaaatatttagct

SEQ ID NO: 611 - DNA, 20 bp, Artificial sequence
  Synthetic oligonucleotide
tcagtcttaaaatatttagc

SEQ ID NO: 612 - DNA, 20 bp, Artificial sequence
  Synthetic oligonucleotide
ttcagtcttaaaatatttag

SEQ ID NO: 613 - DNA, 20 bp, Artificial sequence
  Synthetic oligonucleotide
gttcagtcttaaaatattta

SEQ ID NO: 614 - DNA, 20 bp, Artificial sequence
  Synthetic oligonucleotide
atgttcagtcttaaaatatt

SEQ ID NO: 615 - DNA, 20 bp, Artificial sequence
  Synthetic oligonucleotide
taaatgttcagtcttaaaat

SEQ ID NO: 616 - DNA, 20 bp, Artificial sequence
  Synthetic oligonucleotide
ataaatgttcagtcttaaaa

SEQ ID NO: 617 - DNA, 20 bp, Artificial sequence
  Synthetic oligonucleotide
gtaataattaacataaatgt

SEQ ID NO: 618 - DNA, 20 bp, Artificial sequence
  Synthetic oligonucleotide
ctggtaataattaacataaa

SEQ ID NO: 619 - DNA, 20 bp, Artificial sequence
  Synthetic oligonucleotide
actggtaataattaacataa

SEQ ID NO: 620 - DNA, 20 bp, Artificial sequence
  Synthetic oligonucleotide
ccatggaaaatatgacaaac

SEQ ID NO: 621 - DNA, 20 bp, Artificial sequence
  Synthetic oligonucleotide
acaaatatccatggaaaata

SEQ ID NO: 622 - DNA, 20 bp, Artificial sequence
  Synthetic oligonucleotide
aacaaatatccatggaaaat

SEQ ID NO: 623 - DNA, 20 bp, Artificial sequence
  Synthetic oligonucleotide
gaacaaatatccatggaaaa

SEQ ID NO: 624 - DNA, 20 bp, Artificial sequence
  Synthetic oligonucleotide
tgaacaaatatccatggaaa

SEQ ID NO: 625 - DNA, 20 bp, Artificial sequence
  Synthetic oligonucleotide
aatgaacaaatatccatgga

SEQ ID NO: 626 - DNA, 20 bp, Artificial sequence
  Synthetic oligonucleotide
taatgaacaaatatccatgg

SEQ ID NO: 627 - DNA, 20 bp, Artificial sequence
  Synthetic oligonucleotide
gtaatgaacaaatatccatg

SEQ ID NO: 628 - DNA, 20 bp, Artificial sequence
  Synthetic oligonucleotide
ggtaatgaacaaatatccat

SEQ ID NO: 629 - DNA, 20 bp, Artificial sequence
  Synthetic oligonucleotide
aggtaatgaacaaatatcca

SEQ ID NO: 630 - DNA, 20 bp, Artificial sequence
  Synthetic oligonucleotide
gaaaaaggtaatgaacaaat

SEQ ID NO: 631 - DNA, 20 bp, Artificial sequence
  Synthetic oligonucleotide
caagtgtatgaaaagtttaa

SEQ ID NO: 632 - DNA, 20 bp, Artificial sequence
  Synthetic oligonucleotide
atcaattcaagtgtatgaaa

SEQ ID NO: 633 - DNA, 20 bp, Artificial sequence
  Synthetic oligonucleotide
tcatcaattcaagtgtatga

SEQ ID NO: 634 - DNA, 20 bp, Artificial sequence
  Synthetic oligonucleotide
ctcatcaattcaagtgtatg

SEQ ID NO: 635 - DNA, 20 bp, Artificial sequence
  Synthetic oligonucleotide
agctcatcaattcaagtgta

SEQ ID NO: 636 - DNA, 20 bp, Artificial sequence
  Synthetic oligonucleotide
gtagctcatcaattcaagtg

SEQ ID NO: 637 - DNA, 20 bp, Artificial sequence
  Synthetic oligonucleotide
ggtagctcatcaattcaagt

SEQ ID NO: 638 - DNA, 20 bp, Artificial sequence
  Synthetic oligonucleotide
aggtagctcatcaattcaag

SEQ ID NO: 639 - DNA, 20 bp, Artificial sequence
  Synthetic oligonucleotide
taggtagctcatcaattcaa

SEQ ID NO: 640 - DNA, 20 bp, Artificial sequence
  Synthetic oligonucleotide
ttaggtagctcatcaattca

SEQ ID NO: 641 - DNA, 20 bp, Artificial sequence
  Synthetic oligonucleotide
tattaggtagctcatcaatt

SEQ ID NO: 642 - DNA, 20 bp, Artificial sequence
  Synthetic oligonucleotide
tcatttttatattaggtagc

SEQ ID NO: 643 - DNA, 20 bp, Artificial sequence
  Synthetic oligonucleotide
ctcatttttatattaggtag

SEQ ID NO: 644 - DNA, 20 bp, Artificial sequence
  Synthetic oligonucleotide
tctcatttttatattaggta

SEQ ID NO: 645 - DNA, 20 bp, Artificial sequence
  Synthetic oligonucleotide
ttggttttctcatttttata

SEQ ID NO: 646 - DNA, 20 bp, Artificial sequence
  Synthetic oligonucleotide
attggttttctcatttttat

SEQ ID NO: 647 - DNA, 20 bp, Artificial sequence
  Synthetic oligonucleotide
tattggttttctcattttta

SEQ ID NO: 648 - DNA, 20 bp, Artificial sequence
  Synthetic oligonucleotide
atattggttttctcattttt

SEQ ID NO: 649 - DNA, 20 bp, Artificial sequence
  Synthetic oligonucleotide
catattggttttctcatttt

SEQ ID NO: 650 - DNA, 20 bp, Artificial sequence
  Synthetic oligonucleotide
tgcatattggttttctcatt

SEQ ID NO: 651 - DNA, 20 bp, Artificial sequence
  Synthetic oligonucleotide
atgcatattggttttctcat

SEQ ID NO: 652 - DNA, 20 bp, Artificial sequence
  Synthetic oligonucleotide
aatgcatattggttttctca

SEQ ID NO: 653 - DNA, 20 bp, Artificial sequence
  Synthetic oligonucleotide
aaaatgcatattggttttct

SEQ ID NO: 654 - DNA, 20 bp, Artificial sequence
  Synthetic oligonucleotide
tatatatgaactttataaac

SEQ ID NO: 655 - DNA, 20 bp, Artificial sequence
  Synthetic oligonucleotide
gggtatatatgaactttata

SEQ ID NO: 656 - DNA, 20 bp, Artificial sequence
  Synthetic oligonucleotide
ctagggtatatatgaacttt

SEQ ID NO: 657 - DNA, 20 bp, Artificial sequence
  Synthetic oligonucleotide
actagggtatatatgaactt

SEQ ID NO: 658 - DNA, 20 bp, Artificial sequence
  Synthetic oligonucleotide
aactagggtatatatgaact

SEQ ID NO: 659 - DNA, 20 bp, Artificial sequence
  Synthetic oligonucleotide
aagtgctttaactagggtat

SEQ ID NO: 660 - DNA, 20 bp, Artificial sequence
  Synthetic oligonucleotide
taagtgctttaactagggta

SEQ ID NO: 661 - DNA, 20 bp, Artificial sequence
  Synthetic oligonucleotide
ttaagtgctttaactagggt

SEQ ID NO: 662 - DNA, 20 bp, Artificial sequence
  Synthetic oligonucleotide
ttttcttaagtgctttaact

SEQ ID NO: 663 - DNA, 20 bp, Artificial sequence
  Synthetic oligonucleotide
gccatattttcttaagtgct

SEQ ID NO: 664 - DNA, 20 bp, Artificial sequence
  Synthetic oligonucleotide
actaaaagtcaaacatgcca

SEQ ID NO: 665 - DNA, 20 bp, Artificial sequence
  Synthetic oligonucleotide
gaactaaaagtcaaacatgc

SEQ ID NO: 666 - DNA, 20 bp, Artificial sequence
  Synthetic oligonucleotide
gctctgctttaaaaactctc

SEQ ID NO: 667 - DNA, 20 bp, Artificial sequence
  Synthetic oligonucleotide
cacattcaaacgcatccagt

SEQ ID NO: 668 - DNA, 20 bp, Artificial sequence
  Synthetic oligonucleotide
acacattcaaacgcatccag

SEQ ID NO: 669 - DNA, 20 bp, Artificial sequence
  Synthetic oligonucleotide
caaacacattcaaacgcatc

SEQ ID NO: 670 - DNA, 20 bp, Artificial sequence
  Synthetic oligonucleotide
cacaaacacattcaaacgca

SEQ ID NO: 671 - DNA, 20 bp, Artificial sequence
  Synthetic oligonucleotide
tacacaaacacattcaaacg

SEQ ID NO: 672 - DNA, 20 bp, Artificial sequence
  Synthetic oligonucleotide
ctacacaaacacattcaaac

SEQ ID NO: 673 - DNA, 20 bp, Artificial sequence
  Synthetic oligonucleotide
actacacaaacacattcaaa

SEQ ID NO: 674 - DNA, 20 bp, Artificial sequence
  Synthetic oligonucleotide
caaactacacaaacacattc

SEQ ID NO: 675 - DNA, 20 bp, Artificial sequence
  Synthetic oligonucleotide
acaaactacacaaacacatt

SEQ ID NO: 676 - DNA, 20 bp, Artificial sequence
  Synthetic oligonucleotide
aacaaactacacaaacacat

SEQ ID NO: 677 - DNA, 20 bp, Artificial sequence
  Synthetic oligonucleotide
cacaacaaactacacaaaca

SEQ ID NO: 678 - DNA, 20 bp, Artificial sequence
  Synthetic oligonucleotide
tcacaacaaactacacaaac

SEQ ID NO: 679 - DNA, 20 bp, Artificial sequence
  Synthetic oligonucleotide
ttcacaacaaactacacaaa

SEQ ID NO: 680 - DNA, 20 bp, Artificial sequence
  Synthetic oligonucleotide
atttcacaacaaactacaca

SEQ ID NO: 681 - DNA, 20 bp, Artificial sequence
  Synthetic oligonucleotide
aatttcacaacaaactacac

SEQ ID NO: 682 - DNA, 20 bp, Artificial sequence
  Synthetic oligonucleotide
caatttcacaacaaactaca

SEQ ID NO: 683 - DNA, 20 bp, Artificial sequence
  Synthetic oligonucleotide
taacaatttcacaacaaact

SEQ ID NO: 684 - DNA, 20 bp, Artificial sequence
  Synthetic oligonucleotide
gtaacaatttcacaacaaac

SEQ ID NO: 685 - DNA, 20 bp, Artificial sequence
  Synthetic oligonucleotide
tgtaacaatttcacaacaaa

SEQ ID NO: 686 - DNA, 20 bp, Artificial sequence
  Synthetic oligonucleotide
atgtaacaatttcacaacaa

SEQ ID NO: 687 - DNA, 20 bp, Artificial sequence
  Synthetic oligonucleotide
aatgtaacaatttcacaaca

SEQ ID NO: 688 - DNA, 20 bp, Artificial sequence
  Synthetic oligonucleotide
aaatgtaacaatttcacaac

SEQ ID NO: 689 - DNA, 20 bp, Artificial sequence
  Synthetic oligonucleotide
taaatgtaacaatttcacaa

SEQ ID NO: 690 - DNA, 20 bp, Artificial sequence
  Synthetic oligonucleotide
ctaaatgtaacaatttcaca

SEQ ID NO: 691 - DNA, 20 bp, Artificial sequence
  Synthetic oligonucleotide
gctaaatgtaacaatttcac

SEQ ID NO: 692 - DNA, 20 bp, Artificial sequence
  Synthetic oligonucleotide
tgcctgctaaatgtaacaat

SEQ ID NO: 693 - DNA, 20 bp, Artificial sequence
  Synthetic oligonucleotide
tggatctgcctgctaaatgt

SEQ ID NO: 694 - DNA, 20 bp, Artificial sequence
  Synthetic oligonucleotide
caaccccaccaagatgacag

SEQ ID NO: 695 - DNA, 20 bp, Artificial sequence
  Synthetic oligonucleotide
taagccaaccccaccaagat

SEQ ID NO: 696 - DNA, 20 bp, Artificial sequence
  Synthetic oligonucleotide
ttaagccaaccccaccaaga

SEQ ID NO: 697 - DNA, 20 bp, Artificial sequence
  Synthetic oligonucleotide
aaatttaagccaaccccacc

SEQ ID NO: 698 - DNA, 20 bp, Artificial sequence
  Synthetic oligonucleotide
taaatttaagccaaccccac

SEQ ID NO: 699 - DNA, 20 bp, Artificial sequence
  Synthetic oligonucleotide
gtcaattaaatttaagccaa

SEQ ID NO: 700 - DNA, 20 bp, Artificial sequence
  Synthetic oligonucleotide
acagtcaattaaatttaagc

SEQ ID NO: 701 - DNA, 20 bp, Artificial sequence
  Synthetic oligonucleotide
gaatctaaacagtcaattaa

SEQ ID NO: 702 - DNA, 20 bp, Artificial sequence
  Synthetic oligonucleotide
aatggaatctaaacagtcaa

SEQ ID NO: 703 - DNA, 20 bp, Artificial sequence
  Synthetic oligonucleotide
tactggccaatcaattaaga

SEQ ID NO: 704 - DNA, 20 bp, Artificial sequence
  Synthetic oligonucleotide
ttcatactggccaatcaatt

SEQ ID NO: 705 - DNA, 20 bp, Artificial sequence
  Synthetic oligonucleotide
ttttcatactggccaatcaa

SEQ ID NO: 706 - DNA, 20 bp, Artificial sequence
  Synthetic oligonucleotide
tcttttcatactggccaatc

SEQ ID NO: 707 - DNA, 20 bp, Artificial sequence
  Synthetic oligonucleotide
atcttttcatactggccaat

SEQ ID NO: 708 - DNA, 20 bp, Artificial sequence
  Synthetic oligonucleotide
catcttttcatactggccaa

SEQ ID NO: 709 - DNA, 20 bp, Artificial sequence
  Synthetic oligonucleotide
gcatcttttcatactggcca

SEQ ID NO: 710 - DNA, 20 bp, Artificial sequence
  Synthetic oligonucleotide
ggcatcttttcatactggcc

SEQ ID NO: 711 - DNA, 20 bp, Artificial sequence
  Synthetic oligonucleotide
tggcatcttttcatactggc

SEQ ID NO: 712 - DNA, 20 bp, Artificial sequence
  Synthetic oligonucleotide
ctggcatcttttcatactgg

SEQ ID NO: 713 - DNA, 20 bp, Artificial sequence
  Synthetic oligonucleotide
cactggcatcttttcatact

SEQ ID NO: 714 - DNA, 20 bp, Artificial sequence
  Synthetic oligonucleotide
tactatggttacttgcactg

SEQ ID NO: 715 - DNA, 20 bp, Artificial sequence
  Synthetic oligonucleotide
tatagctttgaataattttt

SEQ ID NO: 716 - DNA, 20 bp, Artificial sequence
  Synthetic oligonucleotide
atgtataaactatagctttg

SEQ ID NO: 717 - DNA, 20 bp, Artificial sequence
  Synthetic oligonucleotide
tgatgtataaactatagctt

SEQ ID NO: 718 - DNA, 20 bp, Artificial sequence
  Synthetic oligonucleotide
gtacctgatgtataaactat

SEQ ID NO: 719 - DNA, 20 bp, Artificial sequence
  Synthetic oligonucleotide
cagtacctgatgtataaact

SEQ ID NO: 720 - DNA, 20 bp, Artificial sequence
  Synthetic oligonucleotide
gcagtacctgatgtataaac

SEQ ID NO: 721 - DNA, 20 bp, Artificial sequence
  Synthetic oligonucleotide
ggcagtacctgatgtataaa

SEQ ID NO: 722 - DNA, 20 bp, Artificial sequence
  Synthetic oligonucleotide
tggcagtacctgatgtataa

SEQ ID NO: 723 - DNA, 20 bp, Artificial sequence
  Synthetic oligonucleotide
atggcagtacctgatgtata

SEQ ID NO: 724 - DNA, 20 bp, Artificial sequence
  Synthetic oligonucleotide
aatggcagtacctgatgtat

SEQ ID NO: 725 - DNA, 20 bp, Artificial sequence
  Synthetic oligonucleotide
aaatggcagtacctgatgta

SEQ ID NO: 726 - DNA, 20 bp, Artificial sequence
  Synthetic oligonucleotide
gtaaatggcagtacctgatg

SEQ ID NO: 727 - DNA, 20 bp, Artificial sequence
  Synthetic oligonucleotide
gtttacagtaaatggcagta

SEQ ID NO: 728 - DNA, 20 bp, Artificial sequence
  Synthetic oligonucleotide
tggtttacagtaaatggcag

SEQ ID NO: 729 - DNA, 20 bp, Artificial sequence
  Synthetic oligonucleotide
ggtggtttacagtaaatggc

SEQ ID NO: 730 - DNA, 20 bp, Artificial sequence
  Synthetic oligonucleotide
aggtggtttacagtaaatgg

SEQ ID NO: 731 - DNA, 20 bp, Artificial sequence
  Synthetic oligonucleotide
gcaggtggtttacagtaaat

SEQ ID NO: 732 - DNA, 20 bp, Artificial sequence
  Synthetic oligonucleotide
ctgactttcttgcaggtggt

SEQ ID NO: 733 - DNA, 20 bp, Artificial sequence
  Synthetic oligonucleotide
ttcctgactttcttgcaggt

SEQ ID NO: 734 - DNA, 20 bp, Artificial sequence
  Synthetic oligonucleotide
gttcctgactttcttgcagg

SEQ ID NO: 735 - DNA, 20 bp, Artificial sequence
  Synthetic oligonucleotide
ttgttcctgactttcttgca

SEQ ID NO: 736 - DNA, 20 bp, Artificial sequence
  Synthetic oligonucleotide
tagttgttcctgactttctt

SEQ ID NO: 737 - DNA, 20 bp, Artificial sequence
  Synthetic oligonucleotide
tttagttgttcctgactttc

SEQ ID NO: 738 - DNA, 20 bp, Artificial sequence
  Synthetic oligonucleotide
aatggaaatctttaatacac

SEQ ID NO: 739 - DNA, 20 bp, Artificial sequence
  Synthetic oligonucleotide
ccaattagtaaaacaaaatg

SEQ ID NO: 740 - DNA, 20 bp, Artificial sequence
  Synthetic oligonucleotide
gatgttcccaattagtaaaa

SEQ ID NO: 741 - DNA, 20 bp, Artificial sequence
  Synthetic oligonucleotide
aagatgttcccaattagtaa

SEQ ID NO: 742 - DNA, 20 bp, Artificial sequence
  Synthetic oligonucleotide
taagatgttcccaattagta

SEQ ID NO: 743 - DNA, 20 bp, Artificial sequence
  Synthetic oligonucleotide
aaacattaagatgttcccaa

SEQ ID NO: 744 - DNA, 20 bp, Artificial sequence
  Synthetic oligonucleotide
taaacattaagatgttccca

SEQ ID NO: 745 - DNA, 20 bp, Artificial sequence
  Synthetic oligonucleotide
attaaacattaagatgttcc

SEQ ID NO: 746 - DNA, 20 bp, Artificial sequence
  Synthetic oligonucleotide
tattaaacattaagatgttc

SEQ ID NO: 747 - DNA, 20 bp, Artificial sequence
  Synthetic oligonucleotide
atattaaacattaagatgtt

SEQ ID NO: 748 - DNA, 20 bp, Artificial sequence
  Synthetic oligonucleotide
aaatattaaacattaagatg

SEQ ID NO: 749 - DNA, 20 bp, Artificial sequence
  Synthetic oligonucleotide
taaatattaaacattaagat

SEQ ID NO: 750 - DNA, 20 bp, Artificial sequence
  Synthetic oligonucleotide
atagtttaaatattaaacat

SEQ ID NO: 751 - DNA, 20 bp, Artificial sequence
  Synthetic oligonucleotide
caatagtttaaatattaaac

SEQ ID NO: 752 - DNA, 20 bp, Artificial sequence
  Synthetic oligonucleotide
ccaatagtttaaatattaaa

SEQ ID NO: 753 - DNA, 20 bp, Artificial sequence
  Synthetic oligonucleotide
accaatagtttaaatattaa

SEQ ID NO: 754 - DNA, 20 bp, Artificial sequence
  Synthetic oligonucleotide
ataccaatagtttaaatatt

SEQ ID NO: 755 - DNA, 20 bp, Artificial sequence
  Synthetic oligonucleotide
aaaatgataccaatagttta

SEQ ID NO: 756 - DNA, 20 bp, Artificial sequence
  Synthetic oligonucleotide
aaaaatgataccaatagttt

SEQ ID NO: 757 - DNA, 20 bp, Artificial sequence
  Synthetic oligonucleotide
gaaaaatgataccaatagtt

SEQ ID NO: 758 - DNA, 20 bp, Artificial sequence
  Synthetic oligonucleotide
agaaaaatgataccaatagt

SEQ ID NO: 759 - DNA, 20 bp, Artificial sequence
  Synthetic oligonucleotide
tagaaaaatgataccaatag

SEQ ID NO: 760 - DNA, 20 bp, Artificial sequence
  Synthetic oligonucleotide
attagaaaaatgataccaat

SEQ ID NO: 761 - DNA, 20 bp, Artificial sequence
  Synthetic oligonucleotide
cattagaaaaatgataccaa

SEQ ID NO: 762 - DNA, 20 bp, Artificial sequence
  Synthetic oligonucleotide
tacattagaaaaatgatacc

SEQ ID NO: 763 - DNA, 20 bp, Artificial sequence
  Synthetic oligonucleotide
atacattagaaaaatgatac

SEQ ID NO: 764 - DNA, 20 bp, Artificial sequence
  Synthetic oligonucleotide
tatacattagaaaaatgata

SEQ ID NO: 765 - DNA, 20 bp, Artificial sequence
  Synthetic oligonucleotide
caaattatacattagaaaaa

SEQ ID NO: 766 - DNA, 20 bp, Artificial sequence
  Synthetic oligonucleotide
acaaattatacattagaaaa

SEQ ID NO: 767 - DNA, 20 bp, Artificial sequence
  Synthetic oligonucleotide
tacaaattatacattagaaa

SEQ ID NO: 768 - DNA, 20 bp, Artificial sequence
  Synthetic oligonucleotide
atacaaattatacattagaa

SEQ ID NO: 769 - DNA, 20 bp, Artificial sequence
  Synthetic oligonucleotide
aatacaaattatacattaga

SEQ ID NO: 770 - DNA, 20 bp, Artificial sequence
  Synthetic oligonucleotide
taatacaaattatacattag

SEQ ID NO: 771 - DNA, 20 bp, Artificial sequence
  Synthetic oligonucleotide
agtaatacaaattatacatt

SEQ ID NO: 772 - DNA, 20 bp, Artificial sequence
  Synthetic oligonucleotide
cccagtaatacaaattatac

SEQ ID NO: 773 - DNA, 20 bp, Artificial sequence
  Synthetic oligonucleotide
tcccagtaatacaaattata

SEQ ID NO: 774 - DNA, 20 bp, Artificial sequence
  Synthetic oligonucleotide
atcccagtaatacaaattat

SEQ ID NO: 775 - DNA, 20 bp, Artificial sequence
  Synthetic oligonucleotide
gatcccagtaatacaaatta

SEQ ID NO: 776 - DNA, 20 bp, Artificial sequence
  Synthetic oligonucleotide
acttgatcccagtaatacaa

SEQ ID NO: 777 - DNA, 20 bp, Artificial sequence
  Synthetic oligonucleotide
tacttgatcccagtaataca

SEQ ID NO: 778 - DNA, 20 bp, Artificial sequence
  Synthetic oligonucleotide
atacttgatcccagtaatac

SEQ ID NO: 779 - DNA, 20 bp, Artificial sequence
  Synthetic oligonucleotide
catacttgatcccagtaata

SEQ ID NO: 780 - DNA, 20 bp, Artificial sequence
  Synthetic oligonucleotide
gtacatacttgatcccagta

SEQ ID NO: 781 - DNA, 20 bp, Artificial sequence
  Synthetic oligonucleotide
ctgtacatacttgatcccag

SEQ ID NO: 782 - DNA, 20 bp, Artificial sequence
  Synthetic oligonucleotide
accactgtacatacttgatc

SEQ ID NO: 783 - DNA, 20 bp, Artificial sequence
  Synthetic oligonucleotide
caccactgtacatacttgat

SEQ ID NO: 784 - DNA, 20 bp, Artificial sequence
  Synthetic oligonucleotide
agcatcaccactgtacatac

SEQ ID NO: 785 - DNA, 20 bp, Artificial sequence
  Synthetic oligonucleotide
tagcatcaccactgtacata

SEQ ID NO: 786 - DNA, 20 bp, Artificial sequence
  Synthetic oligonucleotide
actagcatcaccactgtaca

SEQ ID NO: 787 - DNA, 20 bp, Artificial sequence
  Synthetic oligonucleotide
tactagcatcaccactgtac

SEQ ID NO: 788 - DNA, 20 bp, Artificial sequence
  Synthetic oligonucleotide
ttaaacttctactagcatca

SEQ ID NO: 789 - DNA, 20 bp, Artificial sequence
  Synthetic oligonucleotide
aggcttaaacttctactagc

SEQ ID NO: 790 - DNA, 20 bp, Artificial sequence
  Synthetic oligonucleotide
tccaaggcttaaacttctac

SEQ ID NO: 791 - DNA, 20 bp, Artificial sequence
  Synthetic oligonucleotide
agtggtatttccaaggctta

SEQ ID NO: 792 - DNA, 20 bp, Artificial sequence
  Synthetic oligonucleotide
aagtggtatttccaaggctt

SEQ ID NO: 793 - DNA, 20 bp, Artificial sequence
  Synthetic oligonucleotide
aaagtggtatttccaaggct

SEQ ID NO: 794 - DNA, 20 bp, Artificial sequence
  Synthetic oligonucleotide
tgaaaatatgaaagtggtat

SEQ ID NO: 795 - DNA, 20 bp, Artificial sequence
  Synthetic oligonucleotide
ctgaaaatatgaaagtggta

SEQ ID NO: 796 - DNA, 20 bp, Artificial sequence
  Synthetic oligonucleotide
catctgaaaatatgaaagtg

SEQ ID NO: 797 - DNA, 20 bp, Artificial sequence
  Synthetic oligonucleotide
acatctgaaaatatgaaagt

SEQ ID NO: 798 - DNA, 20 bp, Artificial sequence
  Synthetic oligonucleotide
gacatctgaaaatatgaaag

SEQ ID NO: 799 - DNA, 20 bp, Artificial sequence
  Synthetic oligonucleotide
tgacatctgaaaatatgaaa

SEQ ID NO: 800 - DNA, 20 bp, Artificial sequence
  Synthetic oligonucleotide
atgacatctgaaaatatgaa

SEQ ID NO: 801 - DNA, 20 bp, Artificial sequence
  Synthetic oligonucleotide
taaatccatgacatctgaaa

SEQ ID NO: 802 - DNA, 20 bp, Artificial sequence
  Synthetic oligonucleotide
cattaaatccatgacatctg

SEQ ID NO: 803 - DNA, 20 bp, Artificial sequence
  Synthetic oligonucleotide
tcattaaatccatgacatct

SEQ ID NO: 804 - DNA, 20 bp, Artificial sequence
  Synthetic oligonucleotide
ctcattaaatccatgacatc

SEQ ID NO: 805 - DNA, 20 bp, Artificial sequence
  Synthetic oligonucleotide
tactcattaaatccatgaca

SEQ ID NO: 806 - DNA, 20 bp, Artificial sequence
  Synthetic oligonucleotide
attactcattaaatccatga

SEQ ID NO: 807 - DNA, 20 bp, Artificial sequence
  Synthetic oligonucleotide
aaattactcattaaatccat

SEQ ID NO: 808 - DNA, 20 bp, Artificial sequence
  Synthetic oligonucleotide
taaattactcattaaatcca

SEQ ID NO: 809 - DNA, 20 bp, Artificial sequence
  Synthetic oligonucleotide
ataaattactcattaaatcc

SEQ ID NO: 810 - DNA, 20 bp, Artificial sequence
  Synthetic oligonucleotide
cataaattactcattaaatc

SEQ ID NO: 811 - DNA, 20 bp, Artificial sequence
  Synthetic oligonucleotide
acataaattactcattaaat

SEQ ID NO: 812 - DNA, 20 bp, Artificial sequence
  Synthetic oligonucleotide
aacataaattactcattaaa

SEQ ID NO: 813 - DNA, 20 bp, Artificial sequence
  Synthetic oligonucleotide
aaacataaattactcattaa

SEQ ID NO: 814 - DNA, 20 bp, Artificial sequence
  Synthetic oligonucleotide
aaaacataaattactcatta

SEQ ID NO: 815 - DNA, 20 bp, Artificial sequence
  Synthetic oligonucleotide
aaaaacataaattactcatt

SEQ ID NO: 816 - DNA, 20 bp, Artificial sequence
  Synthetic oligonucleotide
agattaactattctgaattt

SEQ ID NO: 817 - DNA, 20 bp, Artificial sequence
  Synthetic oligonucleotide
gagattaactattctgaatt

SEQ ID NO: 818 - DNA, 20 bp, Artificial sequence
  Synthetic oligonucleotide
agagattaactattctgaat

SEQ ID NO: 819 - DNA, 20 bp, Artificial sequence
  Synthetic oligonucleotide
cagagattaactattctgaa

SEQ ID NO: 820 - DNA, 20 bp, Artificial sequence
  Synthetic oligonucleotide
tcagagattaactattctga

SEQ ID NO: 821 - DNA, 20 bp, Artificial sequence
  Synthetic oligonucleotide
agatcagagattaactattc

SEQ ID NO: 822 - DNA, 20 bp, Artificial sequence
  Synthetic oligonucleotide
tagatcagagattaactatt

SEQ ID NO: 823 - DNA, 20 bp, Artificial sequence
  Synthetic oligonucleotide
ggttttagatcagagattaa

SEQ ID NO: 824 - DNA, 20 bp, Artificial sequence
  Synthetic oligonucleotide
tggttttagatcagagatta

SEQ ID NO: 825 - DNA, 20 bp, Artificial sequence
  Synthetic oligonucleotide
atggttttagatcagagatt

SEQ ID NO: 826 - DNA, 20 bp, Artificial sequence
  Synthetic oligonucleotide
tgatggttttagatcagaga

SEQ ID NO: 827 - DNA, 20 bp, Artificial sequence
  Synthetic oligonucleotide
accgtaaaaaacatagattg

SEQ ID NO: 828 - DNA, 20 bp, Artificial sequence
  Synthetic oligonucleotide
ttaccgtaaaaaacatagat

SEQ ID NO: 829 - DNA, 20 bp, Artificial sequence
  Synthetic oligonucleotide
actgaaatatttacatgatt

SEQ ID NO: 830 - DNA, 20 bp, Artificial sequence
  Synthetic oligonucleotide
gtttatattactgaaatatt

SEQ ID NO: 831 - DNA, 20 bp, Artificial sequence
  Synthetic oligonucleotide
acagtttatattactgaaat

SEQ ID NO: 832 - DNA, 20 bp, Artificial sequence
  Synthetic oligonucleotide
aacagtttatattactgaaa

SEQ ID NO: 833 - DNA, 20 bp, Artificial sequence
  Synthetic oligonucleotide
aaacagtttatattactgaa

SEQ ID NO: 834 - DNA, 20 bp, Artificial sequence
  Synthetic oligonucleotide
caaacagtttatattactga

SEQ ID NO: 835 - DNA, 20 bp, Artificial sequence
  Synthetic oligonucleotide
tcaaacagtttatattactg

SEQ ID NO: 836 - DNA, 20 bp, Artificial sequence
  Synthetic oligonucleotide
tttcaaacagtttatattac

SEQ ID NO: 837 - DNA, 20 bp, Artificial sequence
  Synthetic oligonucleotide
ccttttcaaacagtttatat

SEQ ID NO: 838 - DNA, 20 bp, Artificial sequence
  Synthetic oligonucleotide
gccttttcaaacagtttata

SEQ ID NO: 839 - DNA, 20 bp, Artificial sequence
  Synthetic oligonucleotide
gcagccttttcaaacagttt

SEQ ID NO: 840 - DNA, 20 bp, Artificial sequence
  Synthetic oligonucleotide
cagcagccttttcaaacagt

SEQ ID NO: 841 - DNA, 20 bp, Artificial sequence
  Synthetic oligonucleotide
tgcagcagccttttcaaaca

SEQ ID NO: 842 - DNA, 20 bp, Artificial sequence
  Synthetic oligonucleotide
agagtttacctgcagcagcc

SEQ ID NO: 843 - DNA, 20 bp, Artificial sequence
  Synthetic oligonucleotide
atagagtttacctgcagcag

SEQ ID NO: 844 - DNA, 20 bp, Artificial sequence
  Synthetic oligonucleotide
tatagagtttacctgcagca

SEQ ID NO: 845 - DNA, 20 bp, Artificial sequence
  Synthetic oligonucleotide
gtatagagtttacctgcagc

SEQ ID NO: 846 - DNA, 20 bp, Artificial sequence
  Synthetic oligonucleotide
tagtatagagtttacctgca

SEQ ID NO: 847 - DNA, 20 bp, Artificial sequence
  Synthetic oligonucleotide
attgtaaattatttggccaa

SEQ ID NO: 848 - DNA, 20 bp, Artificial sequence
  Synthetic oligonucleotide
aattgtaaattatttggcca

SEQ ID NO: 849 - DNA, 20 bp, Artificial sequence
  Synthetic oligonucleotide
gaattgtaaattatttggcc

SEQ ID NO: 850 - DNA, 20 bp, Artificial sequence
  Synthetic oligonucleotide
tgaattgtaaattatttggc

SEQ ID NO: 851 - DNA, 20 bp, Artificial sequence
  Synthetic oligonucleotide
gtgaattgtaaattatttgg

SEQ ID NO: 852 - DNA, 20 bp, Artificial sequence
  Synthetic oligonucleotide
attctgtgaattgtaaatta

SEQ ID NO: 853 - DNA, 20 bp, Artificial sequence
  Synthetic oligonucleotide
ccttaaataaaatattctgt

SEQ ID NO: 854 - DNA, 20 bp, Artificial sequence
  Synthetic oligonucleotide
gcaccaccttaaataaaata

SEQ ID NO: 855 - DNA, 20 bp, Artificial sequence
  Synthetic oligonucleotide
aaagcaccaccttaaataaa

SEQ ID NO: 856 - DNA, 20 bp, Artificial sequence
  Synthetic oligonucleotide
atcaagttttaaggacaaaa

SEQ ID NO: 857 - DNA, 20 bp, Artificial sequence
  Synthetic oligonucleotide
aaatcaagttttaaggacaa

SEQ ID NO: 858 - DNA, 20 bp, Artificial sequence
  Synthetic oligonucleotide
aaaatcaagttttaaggaca

SEQ ID NO: 859 - DNA, 20 bp, Artificial sequence
  Synthetic oligonucleotide
aaaaatcaagttttaaggac

SEQ ID NO: 860 - DNA, 20 bp, Artificial sequence
  Synthetic oligonucleotide
aagttaagaaaaatcaagtt

SEQ ID NO: 861 - DNA, 20 bp, Artificial sequence
  Synthetic oligonucleotide
ctttggcatcatgaataaag

SEQ ID NO: 862 - DNA, 20 bp, Artificial sequence
  Synthetic oligonucleotide
aatattaaacaatatggact

SEQ ID NO: 863 - DNA, 20 bp, Artificial sequence
  Synthetic oligonucleotide
ttaatattaaacaatatgga

SEQ ID NO: 864 - DNA, 20 bp, Artificial sequence
  Synthetic oligonucleotide
acttaatattaaacaatatg

SEQ ID NO: 865 - DNA, 20 bp, Artificial sequence
  Synthetic oligonucleotide
aacttaatattaaacaatat

SEQ ID NO: 866 - DNA, 20 bp, Artificial sequence
  Synthetic oligonucleotide
ttttattcaacttaatatta

SEQ ID NO: 867 - DNA, 20 bp, Artificial sequence
  Synthetic oligonucleotide
taaaatttattttattcaac

SEQ ID NO: 868 - DNA, 20 bp, Artificial sequence
  Synthetic oligonucleotide
caaaatgtgatttaggctct

SEQ ID NO: 869 - DNA, 20 bp, Artificial sequence
  Synthetic oligonucleotide
tcagacaatcaaaatgtgat

SEQ ID NO: 870 - DNA, 20 bp, Artificial sequence
  Synthetic oligonucleotide
tcaaaaattcagacaatcaa

SEQ ID NO: 871 - DNA, 20 bp, Artificial sequence
  Synthetic oligonucleotide
tatcaaaaattcagacaatc

SEQ ID NO: 872 - DNA, 20 bp, Artificial sequence
  Synthetic oligonucleotide
gtatcaaaaattcagacaat

SEQ ID NO: 873 - DNA, 20 bp, Artificial sequence
  Synthetic oligonucleotide
atagtatcaaaaattcagac

SEQ ID NO: 874 - DNA, 20 bp, Artificial sequence
  Synthetic oligonucleotide
ggttttaagaatttagtagc

SEQ ID NO: 875 - DNA, 20 bp, Artificial sequence
  Synthetic oligonucleotide
cggttttaagaatttagtag

SEQ ID NO: 876 - DNA, 20 bp, Artificial sequence
  Synthetic oligonucleotide
ggccggttttaagaatttag

SEQ ID NO: 877 - DNA, 20 bp, Artificial sequence
  Synthetic oligonucleotide
gaatctattttttatctgta

SEQ ID NO: 878 - DNA, 20 bp, Artificial sequence
  Synthetic oligonucleotide
aaaattatcatattttgatt

SEQ ID NO: 879 - DNA, 20 bp, Artificial sequence
  Synthetic oligonucleotide
taaaattatcatattttgat

SEQ ID NO: 880 - DNA, 20 bp, Artificial sequence
  Synthetic oligonucleotide
agattttaaaattatcatat

SEQ ID NO: 881 - DNA, 20 bp, Artificial sequence
  Synthetic oligonucleotide
cttaagattttaaaattatc

SEQ ID NO: 882 - DNA, 20 bp, Artificial sequence
  Synthetic oligonucleotide
ctacttaagattttaaaatt

SEQ ID NO: 883 - DNA, 20 bp, Artificial sequence
  Synthetic oligonucleotide
tatttttctacttaagattt

SEQ ID NO: 884 - DNA, 20 bp, Artificial sequence
  Synthetic oligonucleotide
tttatttttctacttaagat

SEQ ID NO: 885 - DNA, 20 bp, Artificial sequence
  Synthetic oligonucleotide
gatttatttttctacttaag

SEQ ID NO: 886 - DNA, 20 bp, Artificial sequence
  Synthetic oligonucleotide
atcaagatttatttttctac

SEQ ID NO: 887 - DNA, 20 bp, Artificial sequence
  Synthetic oligonucleotide
catcaagatttatttttcta

SEQ ID NO: 888 - DNA, 20 bp, Artificial sequence
  Synthetic oligonucleotide
aacatcaagatttatttttc

SEQ ID NO: 889 - DNA, 20 bp, Artificial sequence
  Synthetic oligonucleotide
atttaaaacatcaagattta

SEQ ID NO: 890 - DNA, 20 bp, Artificial sequence
  Synthetic oligonucleotide
taagaatttaaaacatcaag

SEQ ID NO: 891 - DNA, 20 bp, Artificial sequence
  Synthetic oligonucleotide
gtaagaatttaaaacatcaa

SEQ ID NO: 892 - DNA, 20 bp, Artificial sequence
  Synthetic oligonucleotide
caatattaactattgaatcc

SEQ ID NO: 893 - DNA, 20 bp, Artificial sequence
  Synthetic oligonucleotide
ataaagtttttaataggaag

SEQ ID NO: 894 - DNA, 20 bp, Artificial sequence
  Synthetic oligonucleotide
ggataaagtttttaatagga

SEQ ID NO: 895 - DNA, 20 bp, Artificial sequence
  Synthetic oligonucleotide
caaacaaacctttaagatgg

SEQ ID NO: 896 - DNA, 20 bp, Artificial sequence
  Synthetic oligonucleotide
acaaacaaacctttaagatg

SEQ ID NO: 897 - DNA, 20 bp, Artificial sequence
  Synthetic oligonucleotide
tttccggattaaaaaaaaac

SEQ ID NO: 898 - DNA, 20 bp, Artificial sequence
  Synthetic oligonucleotide
aaaaaaaacaaatattcgcc

SEQ ID NO: 899 - DNA, 20 bp, Artificial sequence
  Synthetic oligonucleotide
taaaaaaaacaaatattcgc

SEQ ID NO: 900 - DNA, 20 bp, Artificial sequence
  Synthetic oligonucleotide
aaacaattcactttgaaaac

SEQ ID NO: 901 - DNA, 20 bp, Artificial sequence
  Synthetic oligonucleotide
aacaaacaattcactttgaa

SEQ ID NO: 902 - DNA, 20 bp, Artificial sequence
  Synthetic oligonucleotide
caacaaacaattcactttga

SEQ ID NO: 903 - DNA, 20 bp, Artificial sequence
  Synthetic oligonucleotide
acaacaaacaattcactttg

SEQ ID NO: 904 - DNA, 20 bp, Artificial sequence
  Synthetic oligonucleotide
tacaacaaacaattcacttt

SEQ ID NO: 905 - DNA, 20 bp, Artificial sequence
  Synthetic oligonucleotide
atacaacaaacaattcactt

SEQ ID NO: 906 - DNA, 20 bp, Artificial sequence
  Synthetic oligonucleotide
gatacaacaaacaattcact

SEQ ID NO: 907 - DNA, 20 bp, Artificial sequence
  Synthetic oligonucleotide
ctcgatacaacaaacaattc

SEQ ID NO: 908 - DNA, 20 bp, Artificial sequence
  Synthetic oligonucleotide
gactcgatacaacaaacaat

SEQ ID NO: 909 - DNA, 20 bp, Artificial sequence
  Synthetic oligonucleotide
ggactcgatacaacaaacaa

SEQ ID NO: 910 - DNA, 20 bp, Artificial sequence
  Synthetic oligonucleotide
aggactcgatacaacaaaca

SEQ ID NO: 911 - DNA, 20 bp, Artificial sequence
  Synthetic oligonucleotide
aaggactcgatacaacaaac

SEQ ID NO: 912 - DNA, 20 bp, Artificial sequence
  Synthetic oligonucleotide
ttaaggactcgatacaacaa

SEQ ID NO: 913 - DNA, 20 bp, Artificial sequence
  Synthetic oligonucleotide
tatatccatacttaaggact

SEQ ID NO: 914 - DNA, 20 bp, Artificial sequence
  Synthetic oligonucleotide
gggtcacatatatatccata

SEQ ID NO: 915 - DNA, 20 bp, Artificial sequence
  Synthetic oligonucleotide
tagggtcacatatatatcca

SEQ ID NO: 916 - DNA, 20 bp, Artificial sequence
  Synthetic oligonucleotide
taattagggtcacatatata

SEQ ID NO: 917 - DNA, 20 bp, Artificial sequence
  Synthetic oligonucleotide
cttaattagggtcacatata

SEQ ID NO: 918 - DNA, 20 bp, Artificial sequence
  Synthetic oligonucleotide
tcttaattagggtcacatat

SEQ ID NO: 919 - DNA, 20 bp, Artificial sequence
  Synthetic oligonucleotide
ttcttaattagggtcacata

SEQ ID NO: 920 - DNA, 20 bp, Artificial sequence
  Synthetic oligonucleotide
gttcttaattagggtcacat

SEQ ID NO: 921 - DNA, 20 bp, Artificial sequence
  Synthetic oligonucleotide
agttcttaattagggtcaca

SEQ ID NO: 922 - DNA, 20 bp, Artificial sequence
  Synthetic oligonucleotide
tagttcttaattagggtcac

SEQ ID NO: 923 - DNA, 20 bp, Artificial sequence
  Synthetic oligonucleotide
gtagttcttaattagggtca

SEQ ID NO: 924 - DNA, 20 bp, Artificial sequence
  Synthetic oligonucleotide
tggtagttcttaattagggt

SEQ ID NO: 925 - DNA, 20 bp, Artificial sequence
  Synthetic oligonucleotide
attagttgatccaatctggt

SEQ ID NO: 926 - DNA, 20 bp, Artificial sequence
  Synthetic oligonucleotide
gattagttgatccaatctgg

SEQ ID NO: 927 - DNA, 20 bp, Artificial sequence
  Synthetic oligonucleotide
tgctgacatgattagttgat

SEQ ID NO: 928 - DNA, 20 bp, Artificial sequence
  Synthetic oligonucleotide
ttgctgacatgattagttga

SEQ ID NO: 929 - DNA, 20 bp, Artificial sequence
  Synthetic oligonucleotide
acattgctgacatgattagt

SEQ ID NO: 930 - DNA, 20 bp, Artificial sequence
  Synthetic oligonucleotide
aagttatttacattgctgac

SEQ ID NO: 931 - DNA, 20 bp, Artificial sequence
  Synthetic oligonucleotide
ataaagttatttacattgct

SEQ ID NO: 932 - DNA, 20 bp, Artificial sequence
  Synthetic oligonucleotide
aataaagttatttacattgc

SEQ ID NO: 933 - DNA, 20 bp, Artificial sequence
  Synthetic oligonucleotide
tgaatatgaaaaataaagtt

SEQ ID NO: 934 - DNA, 20 bp, Artificial sequence
  Synthetic oligonucleotide
agtttttattttgaatatga

SEQ ID NO: 935 - DNA, 20 bp, Artificial sequence
  Synthetic oligonucleotide
agaaagtttttattttgaat

SEQ ID NO: 936 - DNA, 20 bp, Artificial sequence
  Synthetic oligonucleotide
gtcattttttaaagcaaaaa

SEQ ID NO: 937 - DNA, 20 bp, Artificial sequence
  Synthetic oligonucleotide
caggtcattttttaaagcaa

SEQ ID NO: 938 - DNA, 20 bp, Artificial sequence
  Synthetic oligonucleotide
aaatacaaagccaggtcatt

SEQ ID NO: 939 - DNA, 20 bp, Artificial sequence
  Synthetic oligonucleotide
ctaaaaaaatacaaagccag

SEQ ID NO: 940 - DNA, 20 bp, Artificial sequence
  Synthetic oligonucleotide
actaaaaaaatacaaagcca

SEQ ID NO: 941 - DNA, 20 bp, Artificial sequence
  Synthetic oligonucleotide
atgtttaagactaaaaaaat

SEQ ID NO: 942 - DNA, 20 bp, Artificial sequence
  Synthetic oligonucleotide
gtcaataatcttcactcatg

SEQ ID NO: 943 - DNA, 20 bp, Artificial sequence
  Synthetic oligonucleotide
cgatgtcaataatcttcact

SEQ ID NO: 944 - DNA, 20 bp, Artificial sequence
  Synthetic oligonucleotide
atttaccaacgatgtcaata

SEQ ID NO: 945 - DNA, 20 bp, Artificial sequence
  Synthetic oligonucleotide
gaatttaccaacgatgtcaa

SEQ ID NO: 946 - DNA, 20 bp, Artificial sequence
  Synthetic oligonucleotide
ctagaatttaccaacgatgt

SEQ ID NO: 947 - DNA, 20 bp, Artificial sequence
  Synthetic oligonucleotide
aattctagaatttaccaacg

SEQ ID NO: 948 - DNA, 20 bp, Artificial sequence
  Synthetic oligonucleotide
aaattctagaatttaccaac

SEQ ID NO: 949 - DNA, 20 bp, Artificial sequence
  Synthetic oligonucleotide
aaaattctagaatttaccaa

SEQ ID NO: 950 - DNA, 20 bp, Artificial sequence
  Synthetic oligonucleotide
atcaaaattctagaatttac

SEQ ID NO: 951 - DNA, 20 bp, Artificial sequence
  Synthetic oligonucleotide
aaatcaaaattctagaattt

SEQ ID NO: 952 - DNA, 20 bp, Artificial sequence
  Synthetic oligonucleotide
caaaatcaaaattctagaat

SEQ ID NO: 953 - DNA, 20 bp, Artificial sequence
  Synthetic oligonucleotide
actaattcttaaaatgccag

SEQ ID NO: 954 - DNA, 20 bp, Artificial sequence
  Synthetic oligonucleotide
cactaattcttaaaatgcca

SEQ ID NO: 955 - DNA, 20 bp, Artificial sequence
  Synthetic oligonucleotide
ttacgacaaatttagaagtt

SEQ ID NO: 956 - DNA, 20 bp, Artificial sequence
  Synthetic oligonucleotide
acatgccaattacgacaaat

SEQ ID NO: 957 - DNA, 20 bp, Artificial sequence
  Synthetic oligonucleotide
atgctattaaacatgccaat

SEQ ID NO: 958 - DNA, 20 bp, Artificial sequence
  Synthetic oligonucleotide
atatgctattaaacatgcca

SEQ ID NO: 959 - DNA, 20 bp, Artificial sequence
  Synthetic oligonucleotide
gatatgctattaaacatgcc

SEQ ID NO: 960 - DNA, 20 bp, Artificial sequence
  Synthetic oligonucleotide
tgatatgctattaaacatgc

SEQ ID NO: 961 - DNA, 20 bp, Artificial sequence
  Synthetic oligonucleotide
atgttttttgatatgctatt

SEQ ID NO: 962 - DNA, 20 bp, Artificial sequence
  Synthetic oligonucleotide
aatgttttttgatatgctat

SEQ ID NO: 963 - DNA, 20 bp, Artificial sequence
  Synthetic oligonucleotide
aaatgttttttgatatgcta

SEQ ID NO: 964 - DNA, 20 bp, Artificial sequence
  Synthetic oligonucleotide
aaaatgttttttgatatgct

SEQ ID NO: 965 - DNA, 20 bp, Artificial sequence
  Synthetic oligonucleotide
ccacaggcttaaaatgtttt

SEQ ID NO: 966 - DNA, 20 bp, Artificial sequence
  Synthetic oligonucleotide
ctatgaatccacaggcttaa

SEQ ID NO: 967 - DNA, 20 bp, Artificial sequence
  Synthetic oligonucleotide
ctaatgtttctcattgcttt

SEQ ID NO: 968 - DNA, 20 bp, Artificial sequence
  Synthetic oligonucleotide
ccatttatattttactaatg

SEQ ID NO: 969 - DNA, 20 bp, Artificial sequence
  Synthetic oligonucleotide
tatccatttatattttacta

SEQ ID NO: 970 - DNA, 20 bp, Artificial sequence
  Synthetic oligonucleotide
ggaatatccatttatatttt

SEQ ID NO: 971 - DNA, 20 bp, Artificial sequence
  Synthetic oligonucleotide
agagcttcctaaatgcatca

SEQ ID NO: 972 - DNA, 20 bp, Artificial sequence
  Synthetic oligonucleotide
aaaacattccttgaactatg

SEQ ID NO: 973 - DNA, 20 bp, Artificial sequence
  Synthetic oligonucleotide
agaaaacattccttgaacta

SEQ ID NO: 974 - DNA, 20 bp, Artificial sequence
  Synthetic oligonucleotide
tcagaaaacattccttgaac

SEQ ID NO: 975 - DNA, 20 bp, Artificial sequence
  Synthetic oligonucleotide
gataatcacatttaaaaatg

SEQ ID NO: 976 - DNA, 20 bp, Artificial sequence
  Synthetic oligonucleotide
aaattagataatcacattta

SEQ ID NO: 977 - DNA, 20 bp, Artificial sequence
  Synthetic oligonucleotide
aaaattagataatcacattt

SEQ ID NO: 978 - DNA, 20 bp, Artificial sequence
  Synthetic oligonucleotide
aaaaattagataatcacatt

SEQ ID NO: 979 - DNA, 20 bp, Artificial sequence
  Synthetic oligonucleotide
taaaaattagataatcacat

SEQ ID NO: 980 - DNA, 20 bp, Artificial sequence
  Synthetic oligonucleotide
tgtaaaaattagataatcac

SEQ ID NO: 981 - DNA, 20 bp, Artificial sequence
  Synthetic oligonucleotide
tgttgtaaaaattagataat

SEQ ID NO: 982 - DNA, 20 bp, Artificial sequence
  Synthetic oligonucleotide
gtgttgtaaaaattagataa

SEQ ID NO: 983 - DNA, 20 bp, Artificial sequence
  Synthetic oligonucleotide
agtgttgtaaaaattagata

SEQ ID NO: 984 - DNA, 20 bp, Artificial sequence
  Synthetic oligonucleotide
cagtgttgtaaaaattagat

SEQ ID NO: 985 - DNA, 20 bp, Artificial sequence
  Synthetic oligonucleotide
taatagcccagtgttgtaaa

SEQ ID NO: 986 - DNA, 20 bp, Artificial sequence
  Synthetic oligonucleotide
cctaatagcccagtgttgta

SEQ ID NO: 987 - DNA, 20 bp, Artificial sequence
  Synthetic oligonucleotide
tcctaatagcccagtgttgt

SEQ ID NO: 988 - DNA, 20 bp, Artificial sequence
  Synthetic oligonucleotide
ttcctaatagcccagtgttg

SEQ ID NO: 989 - DNA, 20 bp, Artificial sequence
  Synthetic oligonucleotide
agttattcctaatagcccag

SEQ ID NO: 990 - DNA, 20 bp, Artificial sequence
  Synthetic oligonucleotide
aagttattcctaatagccca

SEQ ID NO: 991 - DNA, 20 bp, Artificial sequence
  Synthetic oligonucleotide
aaagttattcctaatagccc

SEQ ID NO: 992 - DNA, 20 bp, Artificial sequence
  Synthetic oligonucleotide
aaaagttattcctaatagcc

SEQ ID NO: 993 - DNA, 20 bp, Artificial sequence
  Synthetic oligonucleotide
aaaaagttattcctaatagc

SEQ ID NO: 994 - DNA, 20 bp, Artificial sequence
  Synthetic oligonucleotide
taaaaagttattcctaatag

SEQ ID NO: 995 - DNA, 20 bp, Artificial sequence
  Synthetic oligonucleotide
tttaaaaagttattcctaat

SEQ ID NO: 996 - DNA, 20 bp, Artificial sequence
  Synthetic oligonucleotide
cagaacagtaatttttaaaa

SEQ ID NO: 997 - DNA, 20 bp, Artificial sequence
  Synthetic oligonucleotide
tatacagaacagtaattttt

SEQ ID NO: 998 - DNA, 20 bp, Artificial sequence
  Synthetic oligonucleotide
ttatacagaacagtaatttt

SEQ ID NO: 999 - DNA, 20 bp, Artificial sequence
  Synthetic oligonucleotide
tttatacagaacagtaattt

SEQ ID NO: 1000 - DNA, 20 bp, Artificial sequence
  Synthetic oligonucleotide
atttatacagaacagtaatt

SEQ ID NO: 1001 - DNA, 20 bp, Artificial sequence
  Synthetic oligonucleotide
caaatatttatacagaacag

SEQ ID NO: 1002 - DNA, 20 bp, Artificial sequence
  Synthetic oligonucleotide
ttcaaatatttatacagaac

SEQ ID NO: 1003 - DNA, 20 bp, Artificial sequence
  Synthetic oligonucleotide
tttcaaatatttatacagaa

SEQ ID NO: 1004 - DNA, 20 bp, Artificial sequence
  Synthetic oligonucleotide
atttcaaatatttatacaga

SEQ ID NO: 1005 - DNA, 20 bp, Artificial sequence
  Synthetic oligonucleotide
gaatttcaaatatttataca

SEQ ID NO: 1006 - DNA, 20 bp, Artificial sequence
  Synthetic oligonucleotide
cttgaatttcaaatatttat

SEQ ID NO: 1007 - DNA, 20 bp, Artificial sequence
  Synthetic oligonucleotide
cagatattttctgtacttga

SEQ ID NO: 1008 - DNA, 20 bp, Artificial sequence
  Synthetic oligonucleotide
tttttgtttcagatattttc

SEQ ID NO: 1009 - DNA, 20 bp, Artificial sequence
  Synthetic oligonucleotide
ggccaaacaacaatgctttt

SEQ ID NO: 1010 - DNA, 20 bp, Artificial sequence
  Synthetic oligonucleotide
catggccaaacaacaatgct

SEQ ID NO: 1011 - DNA, 20 bp, Artificial sequence
  Synthetic oligonucleotide
tcatggccaaacaacaatgc

SEQ ID NO: 1012 - DNA, 20 bp, Artificial sequence
  Synthetic oligonucleotide
tatcatggccaaacaacaat

SEQ ID NO: 1013 - DNA, 20 bp, Artificial sequence
  Synthetic oligonucleotide
gcacttgtatcatggccaaa

SEQ ID NO: 1014 - DNA, 20 bp, Artificial sequence
  Synthetic oligonucleotide
tgcacttgtatcatggccaa

SEQ ID NO: 1015 - DNA, 20 bp, Artificial sequence
  Synthetic oligonucleotide
agcaaatgaacttaacgagg

SEQ ID NO: 1016 - DNA, 20 bp, Artificial sequence
  Synthetic oligonucleotide
aataacagcaaatgaactta

SEQ ID NO: 1017 - DNA, 20 bp, Artificial sequence
  Synthetic oligonucleotide
gtgtgtaataacagcaaatg

SEQ ID NO: 1018 - DNA, 20 bp, Artificial sequence
  Synthetic oligonucleotide
gtgtgtgtaataacagcaaa

SEQ ID NO: 1019 - DNA, 20 bp, Artificial sequence
  Synthetic oligonucleotide
tgtgtgtgtaataacagcaa

SEQ ID NO: 1020 - DNA, 20 bp, Artificial sequence
  Synthetic oligonucleotide
gcccggcttttctaacgacc

SEQ ID NO: 1021 - DNA, 20 bp, Artificial sequence
  Synthetic oligonucleotide
cacactaacaacagaatcct

SEQ ID NO: 1022 - DNA, 20 bp, Artificial sequence
  Synthetic oligonucleotide
tccacactaacaacagaatc

SEQ ID NO: 1023 - DNA, 20 bp, Artificial sequence
  Synthetic oligonucleotide
atccacactaacaacagaat

SEQ ID NO: 1024 - DNA, 20 bp, Artificial sequence
  Synthetic oligonucleotide
acatccacactaacaacaga

SEQ ID NO: 1025 - DNA, 20 bp, Artificial sequence
  Synthetic oligonucleotide
aacatccacactaacaacag

SEQ ID NO: 1026 - DNA, 20 bp, Artificial sequence
  Synthetic oligonucleotide
gaacatccacactaacaaca

SEQ ID NO: 1027 - DNA, 20 bp, Artificial sequence
  Synthetic oligonucleotide
ttgaacatccacactaacaa

SEQ ID NO: 1028 - DNA, 20 bp, Artificial sequence
  Synthetic oligonucleotide
tcattgaacatccacactaa

SEQ ID NO: 1029 - DNA, 20 bp, Artificial sequence
  Synthetic oligonucleotide
ctcattgaacatccacacta

SEQ ID NO: 1030 - DNA, 20 bp, Artificial sequence
  Synthetic oligonucleotide
actcattgaacatccacact

SEQ ID NO: 1031 - DNA, 20 bp, Artificial sequence
  Synthetic oligonucleotide
aactcattgaacatccacac

SEQ ID NO: 1032 - DNA, 20 bp, Artificial sequence
  Synthetic oligonucleotide
aaatacaactcattgaacat

SEQ ID NO: 1033 - DNA, 20 bp, Artificial sequence
  Synthetic oligonucleotide
aaaatacaactcattgaaca

SEQ ID NO: 1034 - DNA, 20 bp, Artificial sequence
  Synthetic oligonucleotide
taaaatacaactcattgaac

SEQ ID NO: 1035 - DNA, 20 bp, Artificial sequence
  Synthetic oligonucleotide
ttaaaatacaactcattgaa

SEQ ID NO: 1036 - DNA, 20 bp, Artificial sequence
  Synthetic oligonucleotide
atttaaaatacaactcattg

SEQ ID NO: 1037 - DNA, 20 bp, Artificial sequence
  Synthetic oligonucleotide
atatttaaaatacaactcat

SEQ ID NO: 1038 - DNA, 20 bp, Artificial sequence
  Synthetic oligonucleotide
gatatttaaaatacaactca

SEQ ID NO: 1039 - DNA, 20 bp, Artificial sequence
  Synthetic oligonucleotide
tgatatttaaaatacaactc

SEQ ID NO: 1040 - DNA, 20 bp, Artificial sequence
  Synthetic oligonucleotide
ttgatatttaaaatacaact

SEQ ID NO: 1041 - DNA, 20 bp, Artificial sequence
  Synthetic oligonucleotide
tttgatatttaaaatacaac

SEQ ID NO: 1042 - DNA, 20 bp, Artificial sequence
  Synthetic oligonucleotide
ttaataatctttgatattta

SEQ ID NO: 1043 - DNA, 20 bp, Artificial sequence
  Synthetic oligonucleotide
tctttatttaataatctttg

SEQ ID NO: 1044 - DNA, 20 bp, Artificial sequence
  Synthetic oligonucleotide
attatctttatttaataatc

SEQ ID NO: 1045 - DNA, 20 bp, Artificial sequence
  Synthetic oligonucleotide
aaacattatctttatttaat

SEQ ID NO: 1046 - DNA, 20 bp, Artificial sequence
  Synthetic oligonucleotide
gaaaagcaaacattatcttt

SEQ ID NO: 1047 - DNA, 20 bp, Artificial sequence
  Synthetic oligonucleotide
aaagtgagccttcttgtttc

SEQ ID NO: 1048 - DNA, 20 bp, Artificial sequence
  Synthetic oligonucleotide
acaaagtgagccttcttgtt

SEQ ID NO: 1049 - DNA, 20 bp, Artificial sequence
  Synthetic oligonucleotide
cacaaagtgagccttcttgt

SEQ ID NO: 1050 - DNA, 20 bp, Artificial sequence
  Synthetic oligonucleotide
gcacaaagtgagccttcttg

SEQ ID NO: 1051 - DNA, 20 bp, Artificial sequence
  Synthetic oligonucleotide
agcacaaagtgagccttctt

SEQ ID NO: 1052 - DNA, 20 bp, Artificial sequence
  Synthetic oligonucleotide
gagcacaaagtgagccttct

SEQ ID NO: 1053 - DNA, 20 bp, Artificial sequence
  Synthetic oligonucleotide
tgagcacaaagtgagccttc

SEQ ID NO: 1054 - DNA, 20 bp, Artificial sequence
  Synthetic oligonucleotide
ttgagcacaaagtgagcctt

SEQ ID NO: 1055 - DNA, 20 bp, Artificial sequence
  Synthetic oligonucleotide
tgttgagcacaaagtgagcc

SEQ ID NO: 1056 - DNA, 20 bp, Artificial sequence
  Synthetic oligonucleotide
taagttattcaggcaatgtt

SEQ ID NO: 1057 - DNA, 20 bp, Artificial sequence
  Synthetic oligonucleotide
aataagttattcaggcaatg

SEQ ID NO: 1058 - DNA, 20 bp, Artificial sequence
  Synthetic oligonucleotide
ctaaaatattctccttgcaa

SEQ ID NO: 1059 - DNA, 20 bp, Artificial sequence
  Synthetic oligonucleotide
gctaaaatattctccttgca

SEQ ID NO: 1060 - DNA, 20 bp, Artificial sequence
  Synthetic oligonucleotide
ggctaaaatattctccttgc

SEQ ID NO: 1061 - DNA, 20 bp, Artificial sequence
  Synthetic oligonucleotide
ggataattccacagggctaa

SEQ ID NO: 1062 - DNA, 20 bp, Artificial sequence
  Synthetic oligonucleotide
aggataattccacagggcta

SEQ ID NO: 1063 - DNA, 20 bp, Artificial sequence
  Synthetic oligonucleotide
gaggataattccacagggct

SEQ ID NO: 1064 - DNA, 20 bp, Artificial sequence
  Synthetic oligonucleotide
tgaggataattccacagggc

SEQ ID NO: 1065 - DNA, 20 bp, Artificial sequence
  Synthetic oligonucleotide
ttgaggataattccacaggg

SEQ ID NO: 1066 - DNA, 20 bp, Artificial sequence
  Synthetic oligonucleotide
attgaggataattccacagg

SEQ ID NO: 1067 - DNA, 20 bp, Artificial sequence
  Synthetic oligonucleotide
aattgaggataattccacag

SEQ ID NO: 1068 - DNA, 20 bp, Artificial sequence
  Synthetic oligonucleotide
tctcctcctcatccagctga

SEQ ID NO: 1069 - DNA, 20 bp, Artificial sequence
  Synthetic oligonucleotide
ctctcctcctcatccagctg

SEQ ID NO: 1070 - DNA, 20 bp, Artificial sequence
  Synthetic oligonucleotide
tcctctcctcctcatccagc

SEQ ID NO: 1071 - DNA, 20 bp, Artificial sequence
  Synthetic oligonucleotide
atcctctcctcctcatccag

SEQ ID NO: 1072 - DNA, 20 bp, Artificial sequence
  Synthetic oligonucleotide
tcatcctctcctcctcatcc

SEQ ID NO: 1073 - DNA, 20 bp, Artificial sequence
  Synthetic oligonucleotide
attctcatcctctcctcctc

SEQ ID NO: 1074 - DNA, 20 bp, Artificial sequence
  Synthetic oligonucleotide
cattctcatcctctcctcct

SEQ ID NO: 1075 - DNA, 20 bp, Artificial sequence
  Synthetic oligonucleotide
tgccattctcatcctctcct

SEQ ID NO: 1076 - DNA, 20 bp, Artificial sequence
  Synthetic oligonucleotide
ctgccattctcatcctctcc

SEQ ID NO: 1077 - DNA, 20 bp, Artificial sequence
  Synthetic oligonucleotide
gtaactcctccttctgccat

SEQ ID NO: 1078 - DNA, 20 bp, Artificial sequence
  Synthetic oligonucleotide
ctagtaactcctccttctgc

SEQ ID NO: 1079 - DNA, 20 bp, Artificial sequence
  Synthetic oligonucleotide
actagtaactcctccttctg

SEQ ID NO: 1080 - DNA, 20 bp, Artificial sequence
  Synthetic oligonucleotide
tcactagtaactcctccttc

SEQ ID NO: 1081 - DNA, 20 bp, Artificial sequence
  Synthetic oligonucleotide
ttcactagtaactcctcctt

SEQ ID NO: 1082 - DNA, 20 bp, Artificial sequence
  Synthetic oligonucleotide
tcttcactagtaactcctcc

SEQ ID NO: 1083 - DNA, 20 bp, Artificial sequence
  Synthetic oligonucleotide
gataatcttcactagtaact

SEQ ID NO: 1084 - DNA, 20 bp, Artificial sequence
  Synthetic oligonucleotide
gcgataatcttcactagtaa

SEQ ID NO: 1085 - DNA, 20 bp, Artificial sequence
  Synthetic oligonucleotide
tgcgataatcttcactagta

SEQ ID NO: 1086 - DNA, 20 bp, Artificial sequence
  Synthetic oligonucleotide
gtgcgataatcttcactagt

SEQ ID NO: 1087 - DNA, 20 bp, Artificial sequence
  Synthetic oligonucleotide
cgtgcgataatcttcactag

SEQ ID NO: 1088 - DNA, 20 bp, Artificial sequence
  Synthetic oligonucleotide
agaaggctgctgtaaaaacg

SEQ ID NO: 1089 - DNA, 20 bp, Artificial sequence
  Synthetic oligonucleotide
cagaaggctgctgtaaaaac

SEQ ID NO: 1090 - DNA, 20 bp, Artificial sequence
  Synthetic oligonucleotide
tccagaaggctgctgtaaaa

SEQ ID NO: 1091 - DNA, 20 bp, Artificial sequence
  Synthetic oligonucleotide
ccatatttccagaaggctgc

SEQ ID NO: 1092 - DNA, 20 bp, Artificial sequence
  Synthetic oligonucleotide
tccatatttccagaaggctg

SEQ ID NO: 1093 - DNA, 20 bp, Artificial sequence
  Synthetic oligonucleotide
atccatatttccagaaggct

SEQ ID NO: 1094 - DNA, 20 bp, Artificial sequence
  Synthetic oligonucleotide
catccatatttccagaaggc

SEQ ID NO: 1095 - DNA, 20 bp, Artificial sequence
  Synthetic oligonucleotide
tcatccatatttccagaagg

SEQ ID NO: 1096 - DNA, 20 bp, Artificial sequence
  Synthetic oligonucleotide
gtcatccatatttccagaag

SEQ ID NO: 1097 - DNA, 20 bp, Artificial sequence
  Synthetic oligonucleotide
actgtcatccatatttccag

SEQ ID NO: 1098 - DNA, 20 bp, Artificial sequence
  Synthetic oligonucleotide
cactgtcatccatatttcca

SEQ ID NO: 1099 - DNA, 20 bp, Artificial sequence
  Synthetic oligonucleotide
aaccactgtcatccatattt

SEQ ID NO: 1100 - DNA, 20 bp, Artificial sequence
  Synthetic oligonucleotide
gaaaaaaccactgtcatcca

SEQ ID NO: 1101 - DNA, 20 bp, Artificial sequence
  Synthetic oligonucleotide
agaaaaaaccactgtcatcc

SEQ ID NO: 1102 - DNA, 20 bp, Artificial sequence
  Synthetic oligonucleotide
agagaaaaaaccactgtcat

SEQ ID NO: 1103 - DNA, 20 bp, Artificial sequence
  Synthetic oligonucleotide
tagagaaaaaaccactgtca

SEQ ID NO: 1104 - DNA, 20 bp, Artificial sequence
  Synthetic oligonucleotide
aatagagaaaaaaccactgt

SEQ ID NO: 1105 - DNA, 20 bp, Artificial sequence
  Synthetic oligonucleotide
gaatagagaaaaaaccactg

SEQ ID NO: 1106 - DNA, 20 bp, Artificial sequence
  Synthetic oligonucleotide
tgaatagagaaaaaaccact

SEQ ID NO: 1107 - DNA, 20 bp, Artificial sequence
  Synthetic oligonucleotide
ctgaatagagaaaaaaccac

SEQ ID NO: 1108 - DNA, 20 bp, Artificial sequence
  Synthetic oligonucleotide
ttataacctgaatagagaaa

SEQ ID NO: 1109 - DNA, 20 bp, Artificial sequence
  Synthetic oligonucleotide
gcttataacctgaatagaga

SEQ ID NO: 1110 - DNA, 20 bp, Artificial sequence
  Synthetic oligonucleotide
tgcttataacctgaatagag

SEQ ID NO: 1111 - DNA, 20 bp, Artificial sequence
  Synthetic oligonucleotide
ttgcttataacctgaataga

SEQ ID NO: 1112 - DNA, 20 bp, Artificial sequence
  Synthetic oligonucleotide
attgcttataacctgaatag

SEQ ID NO: 1113 - DNA, 20 bp, Artificial sequence
  Synthetic oligonucleotide
gcattgcttataacctgaat

SEQ ID NO: 1114 - DNA, 20 bp, Artificial sequence
  Synthetic oligonucleotide
ggcattgcttataacctgaa

SEQ ID NO: 1115 - DNA, 20 bp, Artificial sequence
  Synthetic oligonucleotide
cacaaattcaaaaggaaata

SEQ ID NO: 1116 - DNA, 20 bp, Artificial sequence
  Synthetic oligonucleotide
acacaaattcaaaaggaaat

SEQ ID NO: 1117 - DNA, 20 bp, Artificial sequence
  Synthetic oligonucleotide
aaacacaaattcaaaaggaa

SEQ ID NO: 1118 - DNA, 20 bp, Artificial sequence
  Synthetic oligonucleotide
taaacacaaattcaaaagga

SEQ ID NO: 1119 - DNA, 20 bp, Artificial sequence
  Synthetic oligonucleotide
ttaacaataaacacaaattc

SEQ ID NO: 1120 - DNA, 20 bp, Artificial sequence
  Synthetic oligonucleotide
atgaattaacaataaacaca

SEQ ID NO: 1121 - DNA, 20 bp, Artificial sequence
  Synthetic oligonucleotide
tatgaattaacaataaacac

SEQ ID NO: 1122 - DNA, 20 bp, Artificial sequence
  Synthetic oligonucleotide
ctatgaattaacaataaaca

SEQ ID NO: 1123 - DNA, 20 bp, Artificial sequence
  Synthetic oligonucleotide
tagctatgaattaacaataa

SEQ ID NO: 1124 - DNA, 20 bp, Artificial sequence
  Synthetic oligonucleotide
aatagctatgaattaacaat

SEQ ID NO: 1125 - DNA, 20 bp, Artificial sequence
  Synthetic oligonucleotide
aatagaatatcaatggactg

SEQ ID NO: 1126 - DNA, 20 bp, Artificial sequence
  Synthetic oligonucleotide
tggaatagaatatcaatgga

SEQ ID NO: 1127 - DNA, 20 bp, Artificial sequence
  Synthetic oligonucleotide
gctggaatagaatatcaatg

SEQ ID NO: 1128 - DNA, 20 bp, Artificial sequence
  Synthetic oligonucleotide
tcaaataaaaatttggaatt

SEQ ID NO: 1129 - DNA, 20 bp, Artificial sequence
  Synthetic oligonucleotide
ttcaaataaaaatttggaat

SEQ ID NO: 1130 - DNA, 20 bp, Artificial sequence
  Synthetic oligonucleotide
tcctcaatcagtctaggtgg

SEQ ID NO: 1131 - DNA, 20 bp, Artificial sequence
  Synthetic oligonucleotide
ttcctcaatcagtctaggtg

SEQ ID NO: 1132 - DNA, 20 bp, Artificial sequence
  Synthetic oligonucleotide
aatatattcctcaatcagtc

SEQ ID NO: 1133 - DNA, 20 bp, Artificial sequence
  Synthetic oligonucleotide
caatatattcctcaatcagt

SEQ ID NO: 1134 - DNA, 20 bp, Artificial sequence
  Synthetic oligonucleotide
acaatatattcctcaatcag

SEQ ID NO: 1135 - DNA, 20 bp, Artificial sequence
  Synthetic oligonucleotide
gtgcccaatcctaattaaag

SEQ ID NO: 1136 - DNA, 20 bp, Artificial sequence
  Synthetic oligonucleotide
tgtgcccaatcctaattaaa

SEQ ID NO: 1137 - DNA, 20 bp, Artificial sequence
  Synthetic oligonucleotide
atgtttcaaaatttgtgccc

SEQ ID NO: 1138 - DNA, 20 bp, Artificial sequence
  Synthetic oligonucleotide
ttatgtttcaaaatttgtgc

SEQ ID NO: 1139 - DNA, 20 bp, Artificial sequence
  Synthetic oligonucleotide
attatgtttcaaaatttgtg

SEQ ID NO: 1140 - DNA, 20 bp, Artificial sequence
  Synthetic oligonucleotide
accctaatacaagagactct

SEQ ID NO: 1141 - DNA, 20 bp, Artificial sequence
  Synthetic oligonucleotide
tctaccctaatacaagagac

SEQ ID NO: 1142 - DNA, 20 bp, Artificial sequence
  Synthetic oligonucleotide
ccatgtagtgacatgtggct

SEQ ID NO: 1143 - DNA, 20 bp, Artificial sequence
  Synthetic oligonucleotide
ttttggaaaaaatggatctg

SEQ ID NO: 1144 - DNA, 20 bp, Artificial sequence
  Synthetic oligonucleotide
cttttggaaaaaatggatct

SEQ ID NO: 1145 - DNA, 20 bp, Artificial sequence
  Synthetic oligonucleotide
gcttttggaaaaaatggatc

SEQ ID NO: 1146 - DNA, 20 bp, Artificial sequence
  Synthetic oligonucleotide
gaattcaaacacagcttttg

SEQ ID NO: 1147 - DNA, 20 bp, Artificial sequence
  Synthetic oligonucleotide
tgcagaattcaaacacagct

SEQ ID NO: 1148 - DNA, 20 bp, Artificial sequence
  Synthetic oligonucleotide
ctgtgcagaattcaaacaca

SEQ ID NO: 1149 - DNA, 20 bp, Artificial sequence
  Synthetic oligonucleotide
gcccatactccctcccggct

SEQ ID NO: 1150 - DNA, 20 bp, Artificial sequence
  Synthetic oligonucleotide
cggccccgcccatactccct

SEQ ID NO: 1151 - DNA, 20 bp, Artificial sequence
  Synthetic oligonucleotide
agaagcaaacccactgggcg

SEQ ID NO: 1152 - DNA, 20 bp, Artificial sequence
  Synthetic oligonucleotide
gaaaagttaattctgccagg

SEQ ID NO: 1153 - DNA, 20 bp, Artificial sequence
  Synthetic oligonucleotide
acaagaccccaaagatctac

SEQ ID NO: 1154 - DNA, 20 bp, Artificial sequence
  Synthetic oligonucleotide
agtgggcgagccaaggtctc

SEQ ID NO: 1155 - DNA, 20 bp, Artificial sequence
  Synthetic oligonucleotide
gtaataaaaactcttgtgac

SEQ ID NO: 1156 - DNA, 20 bp, Artificial sequence
  Synthetic oligonucleotide
caaacccaaacatcccgtaa

SEQ ID NO: 1157 - DNA, 20 bp, Artificial sequence
  Synthetic oligonucleotide
aaaccaaacccaaacatccc

SEQ ID NO: 1158 - DNA, 20 bp, Artificial sequence
  Synthetic oligonucleotide
tgggagtaccaaaagaaacc

SEQ ID NO: 1159 - DNA, 20 bp, Artificial sequence
  Synthetic oligonucleotide
tacctaaaaacaaagctggc

SEQ ID NO: 1160 - DNA, 20 bp, Artificial sequence
  Synthetic oligonucleotide
atacctaaaaacaaagctgg

SEQ ID NO: 1161 - DNA, 20 bp, Artificial sequence
  Synthetic oligonucleotide
taatacctaaaaacaaagct

SEQ ID NO: 1162 - DNA, 20 bp, Artificial sequence
  Synthetic oligonucleotide
cctaatacctaaaaacaaag

SEQ ID NO: 1163 - DNA, 20 bp, Artificial sequence
  Synthetic oligonucleotide
tcctaatacctaaaaacaaa

SEQ ID NO: 1164 - DNA, 20 bp, Artificial sequence
  Synthetic oligonucleotide
ctcctaatacctaaaaacaa

SEQ ID NO: 1165 - DNA, 20 bp, Artificial sequence
  Synthetic oligonucleotide
actcctaatacctaaaaaca

SEQ ID NO: 1166 - DNA, 20 bp, Artificial sequence
  Synthetic oligonucleotide
cactcctaatacctaaaaac

SEQ ID NO: 1167 - DNA, 20 bp, Artificial sequence
  Synthetic oligonucleotide
ccactcctaatacctaaaaa

SEQ ID NO: 1168 - DNA, 20 bp, Artificial sequence
  Synthetic oligonucleotide
ccagtccactcctaatacct

SEQ ID NO: 1169 - DNA, 20 bp, Artificial sequence
  Synthetic oligonucleotide
acaacaaaatcatcccagtc

SEQ ID NO: 1170 - DNA, 20 bp, Artificial sequence
  Synthetic oligonucleotide
tacaacaaaatcatcccagt

SEQ ID NO: 1171 - DNA, 20 bp, Artificial sequence
  Synthetic oligonucleotide
aacagtatcttcaagtgcat

SEQ ID NO: 1172 - DNA, 20 bp, Artificial sequence
  Synthetic oligonucleotide
aaacagtatcttcaagtgca

SEQ ID NO: 1173 - DNA, 20 bp, Artificial sequence
  Synthetic oligonucleotide
gaggagtttctttacatatc

SEQ ID NO: 1174 - DNA, 20 bp, Artificial sequence
  Synthetic oligonucleotide
aacatgataccatgtgccaa

SEQ ID NO: 1175 - DNA, 20 bp, Artificial sequence
  Synthetic oligonucleotide
aacacgaaactattatgaaa

SEQ ID NO: 1176 - DNA, 20 bp, Artificial sequence
  Synthetic oligonucleotide
tcctcctattaaataacagc

SEQ ID NO: 1177 - DNA, 20 bp, Artificial sequence
  Synthetic oligonucleotide
ctttgctcctcctattaaat

SEQ ID NO: 1178 - DNA, 20 bp, Artificial sequence
  Synthetic oligonucleotide
taaatgatcatttataagta

SEQ ID NO: 1179 - DNA, 20 bp, Artificial sequence
  Synthetic oligonucleotide
tgtgaattttaaatgtctgg

SEQ ID NO: 1180 - DNA, 20 bp, Artificial sequence
  Synthetic oligonucleotide
gtgtgaattttaaatgtctg

SEQ ID NO: 1181 - DNA, 20 bp, Artificial sequence
  Synthetic oligonucleotide
tgtgtgaattttaaatgtct

SEQ ID NO: 1182 - DNA, 20 bp, Artificial sequence
  Synthetic oligonucleotide
gtgtgtgaattttaaatgtc

SEQ ID NO: 1183 - DNA, 20 bp, Artificial sequence
  Synthetic oligonucleotide
tctcccaaaaacattacctg

SEQ ID NO: 1184 - DNA, 20 bp, Artificial sequence
  Synthetic oligonucleotide
cgtctctcccaaaaacatta

SEQ ID NO: 1185 - DNA, 20 bp, Artificial sequence
  Synthetic oligonucleotide
gtacttaacaatttgttcca

SEQ ID NO: 1186 - DNA, 20 bp, Artificial sequence
  Synthetic oligonucleotide
tgtacttaacaatttgttcc

SEQ ID NO: 1187 - DNA, 20 bp, Artificial sequence
  Synthetic oligonucleotide
aagcattgtacttaacaatt

SEQ ID NO: 1188 - DNA, 20 bp, Artificial sequence
  Synthetic oligonucleotide
gagatgttttctacaatgaa

SEQ ID NO: 1189 - DNA, 20 bp, Artificial sequence
  Synthetic oligonucleotide
gcctatttcaaaagtttccg

SEQ ID NO: 1190 - DNA, 20 bp, Artificial sequence
  Synthetic oligonucleotide
agcctatttcaaaagtttcc

SEQ ID NO: 1191 - DNA, 20 bp, Artificial sequence
  Synthetic oligonucleotide
tagtgacaactatacgactg

SEQ ID NO: 1192 - DNA, 20 bp, Artificial sequence
  Synthetic oligonucleotide
ccaagcaaccaaatctctat

SEQ ID NO: 1193 - DNA, 20 bp, Artificial sequence
  Synthetic oligonucleotide
ataacaaaaatatggccggg

SEQ ID NO: 1194 - DNA, 20 bp, Artificial sequence
  Synthetic oligonucleotide
aataacaaaaatatggccgg

SEQ ID NO: 1195 - DNA, 20 bp, Artificial sequence
  Synthetic oligonucleotide
taataacaaaaatatggccg

SEQ ID NO: 1196 - DNA, 20 bp, Artificial sequence
  Synthetic oligonucleotide
ttaataacaaaaatatggcc

SEQ ID NO: 1197 - DNA, 20 bp, Artificial sequence
  Synthetic oligonucleotide
attaataacaaaaatatggc

SEQ ID NO: 1198 - DNA, 20 bp, Artificial sequence
  Synthetic oligonucleotide
aattaataacaaaaatatgg

SEQ ID NO: 1199 - DNA, 20 bp, Artificial sequence
  Synthetic oligonucleotide
ctttgaaaattaataacaaa

SEQ ID NO: 1200 - DNA, 20 bp, Artificial sequence
  Synthetic oligonucleotide
gcctttgaaaattaataaca

SEQ ID NO: 1201 - DNA, 20 bp, Artificial sequence
  Synthetic oligonucleotide
gtcccacaccaaagcctttg

SEQ ID NO: 1202 - DNA, 20 bp, Artificial sequence
  Synthetic oligonucleotide
atattgttaaaaatcttgtc

SEQ ID NO: 1203 - DNA, 20 bp, Artificial sequence
  Synthetic oligonucleotide
caatattgttaaaaatcttg

SEQ ID NO: 1204 - DNA, 20 bp, Artificial sequence
  Synthetic oligonucleotide
aaaaactaaattgttgaatc

SEQ ID NO: 1205 - DNA, 20 bp, Artificial sequence
  Synthetic oligonucleotide
ccaaaaaactaaattgttga

SEQ ID NO: 1206 - DNA, 20 bp, Artificial sequence
  Synthetic oligonucleotide
gcccaaaaaactaaattgtt

SEQ ID NO: 1207 - DNA, 20 bp, Artificial sequence
  Synthetic oligonucleotide
cgcccaaaaaactaaattgt

SEQ ID NO: 1208 - DNA, 20 bp, Artificial sequence
  Synthetic oligonucleotide
cacagtaagcccaaacattc

SEQ ID NO: 1209 - DNA, 20 bp, Artificial sequence
  Synthetic oligonucleotide
agcaagggttaaaggtatat

SEQ ID NO: 1210 - DNA, 20 bp, Artificial sequence
  Synthetic oligonucleotide
ctctccaaacccaggaccta

SEQ ID NO: 1211 - DNA, 20 bp, Artificial sequence
  Synthetic oligonucleotide
ctttagggccaaagttggtt

SEQ ID NO: 1212 - DNA, 20 bp, Artificial sequence
  Synthetic oligonucleotide
acacagcttctttagggcca

SEQ ID NO: 1213 - DNA, 20 bp, Artificial sequence
  Synthetic oligonucleotide
ccaaggttccaagaggaaat

SEQ ID NO: 1214 - DNA, 20 bp, Artificial sequence
  Synthetic oligonucleotide
aagaggaaaccaaggttcca

SEQ ID NO: 1215 - DNA, 20 bp, Artificial sequence
  Synthetic oligonucleotide
aagggtactcaaagtgacta

SEQ ID NO: 1216 - DNA, 20 bp, Artificial sequence
  Synthetic oligonucleotide
tacattctaacttaataaag

SEQ ID NO: 1217 - DNA, 20 bp, Artificial sequence
  Synthetic oligonucleotide
gtttttacattctaacttaa

SEQ ID NO: 1218 - DNA, 20 bp, Artificial sequence
  Synthetic oligonucleotide
aaactgtttttacattctaa

SEQ ID NO: 1219 - DNA, 20 bp, Artificial sequence
  Synthetic oligonucleotide
gaaactgtttttacattcta

SEQ ID NO: 1220 - DNA, 20 bp, Artificial sequence
  Synthetic oligonucleotide
gccccattcaaatatttatt

SEQ ID NO: 1221 - DNA, 20 bp, Artificial sequence
  Synthetic oligonucleotide
tccattcaaatatatacatt

SEQ ID NO: 1222 - DNA, 20 bp, Artificial sequence
  Synthetic oligonucleotide
ttatccattcaaatatatac

SEQ ID NO: 1223 - DNA, 20 bp, Artificial sequence
  Synthetic oligonucleotide
ctctttatccattcaaatat

SEQ ID NO: 1224 - DNA, 20 bp, Artificial sequence
  Synthetic oligonucleotide
tctctttatccattcaaata

SEQ ID NO: 1225 - DNA, 20 bp, Artificial sequence
  Synthetic oligonucleotide
catatatatctcagaaactc

SEQ ID NO: 1226 - DNA, 20 bp, Artificial sequence
  Synthetic oligonucleotide
gcaccatatatatctcagaa

SEQ ID NO: 1227 - DNA, 20 bp, Artificial sequence
  Synthetic oligonucleotide
agcaccatatatatctcaga

SEQ ID NO: 1228 - DNA, 20 bp, Artificial sequence
  Synthetic oligonucleotide
cagcaccatatatatctcag

SEQ ID NO: 1229 - DNA, 20 bp, Artificial sequence
  Synthetic oligonucleotide
aacagcaccatatatatctc

SEQ ID NO: 1230 - DNA, 20 bp, Artificial sequence
  Synthetic oligonucleotide
ctttagataaacagcaccat

SEQ ID NO: 1231 - DNA, 20 bp, Artificial sequence
  Synthetic oligonucleotide
tttactttagataaacagca

SEQ ID NO: 1232 - DNA, 20 bp, Artificial sequence
  Synthetic oligonucleotide
ccttaaaatatttacagaaa

SEQ ID NO: 1233 - DNA, 20 bp, Artificial sequence
  Synthetic oligonucleotide
cctgcaaagccttaaaatat

SEQ ID NO: 1234 - DNA, 20 bp, Artificial sequence
  Synthetic oligonucleotide
tgacagagactacagctggc

SEQ ID NO: 1235 - DNA, 20 bp, Artificial sequence
  Synthetic oligonucleotide
gttgggaaaaacatgcacaa

SEQ ID NO: 1236 - DNA, 20 bp, Artificial sequence
  Synthetic oligonucleotide
tggttgggaaaaacatgcac

SEQ ID NO: 1237 - DNA, 20 bp, Artificial sequence
  Synthetic oligonucleotide
actttacatttttacatggt

SEQ ID NO: 1238 - DNA, 20 bp, Artificial sequence
  Synthetic oligonucleotide
agtagctaagaatgcacttt

SEQ ID NO: 1239 - DNA, 20 bp, Artificial sequence
  Synthetic oligonucleotide
atgggccaaattcaacctgc

SEQ ID NO: 1240 - DNA, 20 bp, Artificial sequence
  Synthetic oligonucleotide
caacaaaaatccagtagtgg

SEQ ID NO: 1241 - DNA, 20 bp, Artificial sequence
  Synthetic oligonucleotide
acaacaaaaatccagtagtg

SEQ ID NO: 1242 - DNA, 20 bp, Artificial sequence
  Synthetic oligonucleotide
cagaactaaaacaaacaaca

SEQ ID NO: 1243 - DNA, 20 bp, Artificial sequence
  Synthetic oligonucleotide
accagaactaaaacaaacaa

SEQ ID NO: 1244 - DNA, 20 bp, Artificial sequence
  Synthetic oligonucleotide
caccagaactaaaacaaaca

SEQ ID NO: 1245 - DNA, 20 bp, Artificial sequence
  Synthetic oligonucleotide
ggcaccagaactaaaacaaa

SEQ ID NO: 1246 - DNA, 20 bp, Artificial sequence
  Synthetic oligonucleotide
agcaggcaccagaactaaaa

SEQ ID NO: 1247 - DNA, 20 bp, Artificial sequence
  Synthetic oligonucleotide
taactgcaccaagaaacatc

SEQ ID NO: 1248 - DNA, 20 bp, Artificial sequence
  Synthetic oligonucleotide
gcaccaatacaaatggcaca

SEQ ID NO: 1249 - DNA, 20 bp, Artificial sequence
  Synthetic oligonucleotide
aagcaccaatacaaatggca

SEQ ID NO: 1250 - DNA, 20 bp, Artificial sequence
  Synthetic oligonucleotide
tttgcattacattaaaagca

SEQ ID NO: 1251 - DNA, 20 bp, Artificial sequence
  Synthetic oligonucleotide
gatattattaccagtttgca

SEQ ID NO: 1252 - DNA, 20 bp, Artificial sequence
  Synthetic oligonucleotide
atgtacaaccccagcaagtt

SEQ ID NO: 1253 - DNA, 20 bp, Artificial sequence
  Synthetic oligonucleotide
tatgtacaaccccagcaagt

SEQ ID NO: 1254 - DNA, 20 bp, Artificial sequence
  Synthetic oligonucleotide
ttcaataattttatgtacaa

SEQ ID NO: 1255 - DNA, 20 bp, Artificial sequence
  Synthetic oligonucleotide
gggcataatgaatgccacag

SEQ ID NO: 1256 - DNA, 20 bp, Artificial sequence
  Synthetic oligonucleotide
tggctaaaatccagcaatca

SEQ ID NO: 1257 - DNA, 20 bp, Artificial sequence
  Synthetic oligonucleotide
ggcttctcctaaagctcaaa

SEQ ID NO: 1258 - DNA, 20 bp, Artificial sequence
  Synthetic oligonucleotide
tcatttatacagaatttggc

SEQ ID NO: 1259 - DNA, 20 bp, Artificial sequence
  Synthetic oligonucleotide
gcacttcaagtcatttatac

SEQ ID NO: 1260 - DNA, 20 bp, Artificial sequence
  Synthetic oligonucleotide
actatctgccagggagcctt

SEQ ID NO: 1261 - DNA, 20 bp, Artificial sequence
  Synthetic oligonucleotide
ggcaatggccagtacttcta

SEQ ID NO: 1262 - DNA, 20 bp, Artificial sequence
  Synthetic oligonucleotide
tctccgagcccttactatga

SEQ ID NO: 1263 - DNA, 20 bp, Artificial sequence
  Synthetic oligonucleotide
aggtataaacctaaggtgct

SEQ ID NO: 1264 - DNA, 20 bp, Artificial sequence
  Synthetic oligonucleotide
acaacacaaatcaggtataa

SEQ ID NO: 1265 - DNA, 20 bp, Artificial sequence
  Synthetic oligonucleotide
actacaacacaaatcaggta

SEQ ID NO: 1266 - DNA, 20 bp, Artificial sequence
  Synthetic oligonucleotide
taactacaacacaaatcagg

SEQ ID NO: 1267 - DNA, 20 bp, Artificial sequence
  Synthetic oligonucleotide
cactactaactacaacacaa

SEQ ID NO: 1268 - DNA, 20 bp, Artificial sequence
  Synthetic oligonucleotide
acactactaactacaacaca

SEQ ID NO: 1269 - DNA, 20 bp, Artificial sequence
  Synthetic oligonucleotide
cagagacactactaactaca

SEQ ID NO: 1270 - DNA, 20 bp, Artificial sequence
  Synthetic oligonucleotide
gttcaaattaccagagacac

SEQ ID NO: 1271 - DNA, 20 bp, Artificial sequence
  Synthetic oligonucleotide
tagttcaaattaccagagac

SEQ ID NO: 1272 - DNA, 20 bp, Artificial sequence
  Synthetic oligonucleotide
ctagttcaaattaccagaga

SEQ ID NO: 1273 - DNA, 20 bp, Artificial sequence
  Synthetic oligonucleotide
aaactagttcaaattaccag

SEQ ID NO: 1274 - DNA, 20 bp, Artificial sequence
  Synthetic oligonucleotide
caagaccaacctgaaactag

SEQ ID NO: 1275 - DNA, 20 bp, Artificial sequence
  Synthetic oligonucleotide
gttttcaagaccaacctgaa

SEQ ID NO: 1276 - DNA, 20 bp, Artificial sequence
  Synthetic oligonucleotide
tcatttacccccaacctccc

SEQ ID NO: 1277 - DNA, 20 bp, Artificial sequence
  Synthetic oligonucleotide
aaatcatttacccccaacct

SEQ ID NO: 1278 - DNA, 20 bp, Artificial sequence
  Synthetic oligonucleotide
taccaaatcatttaccccca

SEQ ID NO: 1279 - DNA, 20 bp, Artificial sequence
  Synthetic oligonucleotide
gctaccaaatcatttacccc

SEQ ID NO: 1280 - DNA, 20 bp, Artificial sequence
  Synthetic oligonucleotide
tgctaccaaatcatttaccc

SEQ ID NO: 1281 - DNA, 20 bp, Artificial sequence
  Synthetic oligonucleotide
aactgctaccaaatcattta

SEQ ID NO: 1282 - DNA, 20 bp, Artificial sequence
  Synthetic oligonucleotide
gcagttctacaaagataatg

SEQ ID NO: 1283 - DNA, 20 bp, Artificial sequence
  Synthetic oligonucleotide
attgaaatctcatgatttgg

SEQ ID NO: 1284 - DNA, 20 bp, Artificial sequence
  Synthetic oligonucleotide
tattgaaatctcatgatttg

SEQ ID NO: 1285 - DNA, 20 bp, Artificial sequence
  Synthetic oligonucleotide
tgccataatcaaagttcagc

SEQ ID NO: 1286 - DNA, 20 bp, Artificial sequence
  Synthetic oligonucleotide
tttgccataatcaaagttca

SEQ ID NO: 1287 - DNA, 20 bp, Artificial sequence
  Synthetic oligonucleotide
tcactttgccataatcaaag

SEQ ID NO: 1288 - DNA, 20 bp, Artificial sequence
  Synthetic oligonucleotide
gttcactttgccataatcaa

SEQ ID NO: 1289 - DNA, 20 bp, Artificial sequence
  Synthetic oligonucleotide
agctttaatcaaagcagaag

SEQ ID NO: 1290 - DNA, 20 bp, Artificial sequence
  Synthetic oligonucleotide
tcaagctttaatcaaagcag

SEQ ID NO: 1291 - DNA, 20 bp, Artificial sequence
  Synthetic oligonucleotide
tcaaactatccccagccacc

SEQ ID NO: 1292 - DNA, 20 bp, Artificial sequence
  Synthetic oligonucleotide
tatctcaaactatccccagc

SEQ ID NO: 1293 - DNA, 20 bp, Artificial sequence
  Synthetic oligonucleotide
cttatctcaaactatcccca

SEQ ID NO: 1294 - DNA, 20 bp, Artificial sequence
  Synthetic oligonucleotide
tgcccttatctcaaactatc

SEQ ID NO: 1295 - DNA, 20 bp, Artificial sequence
  Synthetic oligonucleotide
ctgccttgcccttatctcaa

SEQ ID NO: 1296 - DNA, 20 bp, Artificial sequence
  Synthetic oligonucleotide
tatgcattttcctgccttgc

SEQ ID NO: 1297 - DNA, 20 bp, Artificial sequence
  Synthetic oligonucleotide
accaaaagaattgtacaatg

SEQ ID NO: 1298 - DNA, 20 bp, Artificial sequence
  Synthetic oligonucleotide
ggaccaaaagaattgtacaa

SEQ ID NO: 1299 - DNA, 20 bp, Artificial sequence
  Synthetic oligonucleotide
cacatggaccaaaagaattg

SEQ ID NO: 1300 - DNA, 20 bp, Artificial sequence
  Synthetic oligonucleotide
acggatcaaattccacatgg

SEQ ID NO: 1301 - DNA, 20 bp, Artificial sequence
  Synthetic oligonucleotide
tggttcatactataatctca

SEQ ID NO: 1302 - DNA, 20 bp, Artificial sequence
  Synthetic oligonucleotide
tcagtacaaatttaaaaatc

SEQ ID NO: 1303 - DNA, 20 bp, Artificial sequence
  Synthetic oligonucleotide
tgttcagtacaaatttaaaa

SEQ ID NO: 1304 - DNA, 20 bp, Artificial sequence
  Synthetic oligonucleotide
caaactgttcagtacaaatt

SEQ ID NO: 1305 - DNA, 20 bp, Artificial sequence
  Synthetic oligonucleotide
aaaggacaaactgttcagta

SEQ ID NO: 1306 - DNA, 20 bp, Artificial sequence
  Synthetic oligonucleotide
ttctaatatgatttaatgga

SEQ ID NO: 1307 - DNA, 20 bp, Artificial sequence
  Synthetic oligonucleotide
cttctaatatgatttaatgg

SEQ ID NO: 1308 - DNA, 20 bp, Artificial sequence
  Synthetic oligonucleotide
caggaaatatcaagttctgt

SEQ ID NO: 1309 - DNA, 20 bp, Artificial sequence
  Synthetic oligonucleotide
acaggaaatatcaagttctg

SEQ ID NO: 1310 - DNA, 20 bp, Artificial sequence
  Synthetic oligonucleotide
caaagaaaaactgtattgct

SEQ ID NO: 1311 - DNA, 20 bp, Artificial sequence
  Synthetic oligonucleotide
aaatcaaacttcatcaaaga

SEQ ID NO: 1312 - DNA, 20 bp, Artificial sequence
  Synthetic oligonucleotide
gaaatcaaacttcatcaaag

SEQ ID NO: 1313 - DNA, 20 bp, Artificial sequence
  Synthetic oligonucleotide
tgaaatcaaacttcatcaaa

SEQ ID NO: 1314 - DNA, 20 bp, Artificial sequence
  Synthetic oligonucleotide
acttgaaatcaaacttcatc

SEQ ID NO: 1315 - DNA, 20 bp, Artificial sequence
  Synthetic oligonucleotide
tagctttaaattatgaaaaa

SEQ ID NO: 1316 - DNA, 20 bp, Artificial sequence
  Synthetic oligonucleotide
atagctttaaattatgaaaa

SEQ ID NO: 1317 - DNA, 20 bp, Artificial sequence
  Synthetic oligonucleotide
aaatagctttaaattatgaa

SEQ ID NO: 1318 - DNA, 20 bp, Artificial sequence
  Synthetic oligonucleotide
ctctataaaaaatagcttta

SEQ ID NO: 1319 - DNA, 20 bp, Artificial sequence
  Synthetic oligonucleotide
ttgattaaaattctctctat

SEQ ID NO: 1320 - DNA, 20 bp, Artificial sequence
  Synthetic oligonucleotide
gacatccaaatatttgatta

SEQ ID NO: 1321 - DNA, 20 bp, Artificial sequence
  Synthetic oligonucleotide
agtgacatccaaatatttga

SEQ ID NO: 1322 - DNA, 20 bp, Artificial sequence
  Synthetic oligonucleotide
cttaataccatatatagcaa

SEQ ID NO: 1323 - DNA, 20 bp, Artificial sequence
  Synthetic oligonucleotide
tacttaataccatatatagc

SEQ ID NO: 1324 - DNA, 20 bp, Artificial sequence
  Synthetic oligonucleotide
atacttaataccatatatag

SEQ ID NO: 1325 - DNA, 20 bp, Artificial sequence
  Synthetic oligonucleotide
tatggtcaccatacttaata

SEQ ID NO: 1326 - DNA, 20 bp, Artificial sequence
  Synthetic oligonucleotide
gtttacaaactatggtcacc

SEQ ID NO: 1327 - DNA, 20 bp, Artificial sequence
  Synthetic oligonucleotide
gagtttacaaactatggtca

SEQ ID NO: 1328 - DNA, 20 bp, Artificial sequence
  Synthetic oligonucleotide
cacaaatttcctgtcttgct

SEQ ID NO: 1329 - DNA, 20 bp, Artificial sequence
  Synthetic oligonucleotide
ctaacacaaatttcctgtct

SEQ ID NO: 1330 - DNA, 20 bp, Artificial sequence
  Synthetic oligonucleotide
ttgctaacacaaatttcctg

SEQ ID NO: 1331 - DNA, 20 bp, Artificial sequence
  Synthetic oligonucleotide
ctttgctaacacaaatttcc

SEQ ID NO: 1332 - DNA, 20 bp, Artificial sequence
  Synthetic oligonucleotide
agaaaaaagcctttgctaac

SEQ ID NO: 1333 - DNA, 20 bp, Artificial sequence
  Synthetic oligonucleotide
taaaaaattcaaacagtaag

SEQ ID NO: 1334 - DNA, 20 bp, Artificial sequence
  Synthetic oligonucleotide
tcaggcaaaactcatttatg

SEQ ID NO: 1335 - DNA, 20 bp, Artificial sequence
  Synthetic oligonucleotide
tccagtcacaaaagctcaaa

SEQ ID NO: 1336 - DNA, 20 bp, Artificial sequence
  Synthetic oligonucleotide
ttccagtcacaaaagctcaa

SEQ ID NO: 1337 - DNA, 20 bp, Artificial sequence
  Synthetic oligonucleotide
atggtaaactaaagaggaca

SEQ ID NO: 1338 - DNA, 20 bp, Artificial sequence
  Synthetic oligonucleotide
acaatggtaaactaaagagg

SEQ ID NO: 1339 - DNA, 20 bp, Artificial sequence
  Synthetic oligonucleotide
tttctcaaacaatggtaaac

SEQ ID NO: 1340 - DNA, 20 bp, Artificial sequence
  Synthetic oligonucleotide
gataaatttctcaaacaatg

SEQ ID NO: 1341 - DNA, 20 bp, Artificial sequence
  Synthetic oligonucleotide
aattaacaataattaacagt

SEQ ID NO: 1342 - DNA, 20 bp, Artificial sequence
  Synthetic oligonucleotide
gttaattaacaataattaac

SEQ ID NO: 1343 - DNA, 20 bp, Artificial sequence
  Synthetic oligonucleotide
atgaattaactacaacagta

SEQ ID NO: 1344 - DNA, 20 bp, Artificial sequence
  Synthetic oligonucleotide
ctcacaaaagaatactagat

SEQ ID NO: 1345 - DNA, 20 bp, Artificial sequence
  Synthetic oligonucleotide
gtgtttactcacaaaagaat

SEQ ID NO: 1346 - DNA, 20 bp, Artificial sequence
  Synthetic oligonucleotide
gaaacgacccaaatggatag

SEQ ID NO: 1347 - DNA, 20 bp, Artificial sequence
  Synthetic oligonucleotide
tggaaacgacccaaatggat

SEQ ID NO: 1348 - DNA, 20 bp, Artificial sequence
  Synthetic oligonucleotide
atagcattactatttgtaat

SEQ ID NO: 1349 - DNA, 20 bp, Artificial sequence
  Synthetic oligonucleotide
atagcattacagatagcatt

SEQ ID NO: 1350 - DNA, 20 bp, Artificial sequence
  Synthetic oligonucleotide
gtagtaatacaaaatagcat

SEQ ID NO: 1351 - DNA, 20 bp, Artificial sequence
  Synthetic oligonucleotide
atagcattactatttgtagt

SEQ ID NO: 1352 - DNA, 20 bp, Artificial sequence
  Synthetic oligonucleotide
atctcctatgatctagcaat

SEQ ID NO: 1353 - DNA, 20 bp, Artificial sequence
  Synthetic oligonucleotide
aagcttaatatatacatctc

SEQ ID NO: 1354 - DNA, 20 bp, Artificial sequence
  Synthetic oligonucleotide
taaagcttaatatatacatc

SEQ ID NO: 1355 - DNA, 20 bp, Artificial sequence
  Synthetic oligonucleotide
actaataattatgtaatgca

SEQ ID NO: 1356 - DNA, 20 bp, Artificial sequence
  Synthetic oligonucleotide
taactaataattatgtaatg

SEQ ID NO: 1357 - DNA, 20 bp, Artificial sequence
  Synthetic oligonucleotide
ataactaataattatgtaat

SEQ ID NO: 1358 - DNA, 20 bp, Artificial sequence
  Synthetic oligonucleotide
aataactaataattatgtaa

SEQ ID NO: 1359 - DNA, 20 bp, Artificial sequence
  Synthetic oligonucleotide
ccaataataactaataatta

SEQ ID NO: 1360 - DNA, 20 bp, Artificial sequence
  Synthetic oligonucleotide
accaataataactaataatt

SEQ ID NO: 1361 - DNA, 20 bp, Artificial sequence
  Synthetic oligonucleotide
ttggtataaccaataataac

SEQ ID NO: 1362 - DNA, 20 bp, Artificial sequence
  Synthetic oligonucleotide
cacaaactctaaaatggcta

SEQ ID NO: 1363 - DNA, 20 bp, Artificial sequence
  Synthetic oligonucleotide
ggcaagacaaacaagcactt

SEQ ID NO: 1364 - DNA, 20 bp, Artificial sequence
  Synthetic oligonucleotide
cttgagccccaaaaaggtcg

SEQ ID NO: 1365 - DNA, 20 bp, Artificial sequence
  Synthetic oligonucleotide
tgaaaaatagccaaggctgg

SEQ ID NO: 1366 - DNA, 20 bp, Artificial sequence
  Synthetic oligonucleotide
ctacttatatccttttgaaa

SEQ ID NO: 1367 - DNA, 20 bp, Artificial sequence
  Synthetic oligonucleotide
ggatatacagatgttctact

SEQ ID NO: 1368 - DNA, 20 bp, Artificial sequence
  Synthetic oligonucleotide
agggatatacagatgttcta

SEQ ID NO: 1369 - DNA, 20 bp, Artificial sequence
  Synthetic oligonucleotide
gaagggatatacagatgttc

SEQ ID NO: 1370 - DNA, 20 bp, Artificial sequence
  Synthetic oligonucleotide
tactgaataatatgcaaatt

SEQ ID NO: 1371 - DNA, 20 bp, Artificial sequence
  Synthetic oligonucleotide
actcttactgaataatatgc

SEQ ID NO: 1372 - DNA, 20 bp, Artificial sequence
  Synthetic oligonucleotide
tatttctactaccagagtgc

SEQ ID NO: 1373 - DNA, 20 bp, Artificial sequence
  Synthetic oligonucleotide
ctttctcctccttatatatt

SEQ ID NO: 1374 - DNA, 20 bp, Artificial sequence
  Synthetic oligonucleotide
aagtttatcttcaacttttc

SEQ ID NO: 1375 - DNA, 20 bp, Artificial sequence
  Synthetic oligonucleotide
taagtttatcttcaactttt

SEQ ID NO: 1376 - DNA, 20 bp, Artificial sequence
  Synthetic oligonucleotide
gtgaaaaaaatatgggttat

SEQ ID NO: 1377 - DNA, 20 bp, Artificial sequence
  Synthetic oligonucleotide
ggtgaaaaaaatatgggtta

SEQ ID NO: 1378 - DNA, 20 bp, Artificial sequence
  Synthetic oligonucleotide
tggtgaaaaaaatatgggtt

SEQ ID NO: 1379 - DNA, 20 bp, Artificial sequence
  Synthetic oligonucleotide
ctggtgaaaaaaatatgggt

SEQ ID NO: 1380 - DNA, 20 bp, Artificial sequence
  Synthetic oligonucleotide
agctggtgaaaaaaatatgg

SEQ ID NO: 1381 - DNA, 20 bp, Artificial sequence
  Synthetic oligonucleotide
tcagctggtgaaaaaaatat

SEQ ID NO: 1382 - DNA, 20 bp, Artificial sequence
  Synthetic oligonucleotide
aggagcaaaattcagctggt

SEQ ID NO: 1383 - DNA, 20 bp, Artificial sequence
  Synthetic oligonucleotide
aaagagaaccaccttgcaag

SEQ ID NO: 1384 - DNA, 20 bp, Artificial sequence
  Synthetic oligonucleotide
ctaaagagaaccaccttgca

SEQ ID NO: 1385 - DNA, 20 bp, Artificial sequence
  Synthetic oligonucleotide
ttccttaacccaacctatct

SEQ ID NO: 1386 - DNA, 20 bp, Artificial sequence
  Synthetic oligonucleotide
attccttaacccaacctatc

SEQ ID NO: 1387 - DNA, 20 bp, Artificial sequence
  Synthetic oligonucleotide
ggtctattccttaacccaac

SEQ ID NO: 1388 - DNA, 20 bp, Artificial sequence
  Synthetic oligonucleotide
aggtctattccttaacccaa

SEQ ID NO: 1389 - DNA, 20 bp, Artificial sequence
  Synthetic oligonucleotide
aaggtctattccttaaccca

SEQ ID NO: 1390 - DNA, 20 bp, Artificial sequence
  Synthetic oligonucleotide
tctctctttccccaataagg

SEQ ID NO: 1391 - DNA, 20 bp, Artificial sequence
  Synthetic oligonucleotide
agaacatttccttctcctgc

SEQ ID NO: 1392 - DNA, 20 bp, Artificial sequence
  Synthetic oligonucleotide
tgaatccaagtccagggtgc

SEQ ID NO: 1393 - DNA, 20 bp, Artificial sequence
  Synthetic oligonucleotide
gggcagtttctcacacaact

SEQ ID NO: 1394 - DNA, 20 bp, Artificial sequence
  Synthetic oligonucleotide
cctggacaagccagcaagag

SEQ ID NO: 1395 - DNA, 20 bp, Artificial sequence
  Synthetic oligonucleotide
gaactgtcccaaacaaccct

SEQ ID NO: 1396 - DNA, 20 bp, Artificial sequence
  Synthetic oligonucleotide
ggaactctacagataatgta

SEQ ID NO: 1397 - DNA, 20 bp, Artificial sequence
  Synthetic oligonucleotide
gttccatgttaaaacttgca

SEQ ID NO: 1398 - DNA, 20 bp, Artificial sequence
  Synthetic oligonucleotide
attctgttccatgttaaaac

SEQ ID NO: 1399 - DNA, 20 bp, Artificial sequence
  Synthetic oligonucleotide
gtgagaaaaattctgttcca

SEQ ID NO: 1400 - DNA, 20 bp, Artificial sequence
  Synthetic oligonucleotide
caggtgagaaaaattctgtt

SEQ ID NO: 1401 - DNA, 20 bp, Artificial sequence
  Synthetic oligonucleotide
cacacaatctaaatgcttgt

SEQ ID NO: 1402 - DNA, 20 bp, Artificial sequence
  Synthetic oligonucleotide
catttattcttttaacatga

SEQ ID NO: 1403 - DNA, 20 bp, Artificial sequence
  Synthetic oligonucleotide
agaacatttattcttttaac

SEQ ID NO: 1404 - DNA, 20 bp, Artificial sequence
  Synthetic oligonucleotide
ccctagaacatttattcttt

SEQ ID NO: 1405 - DNA, 20 bp, Artificial sequence
  Synthetic oligonucleotide
gaaaggaaattttagtccct

SEQ ID NO: 1406 - DNA, 20 bp, Artificial sequence
  Synthetic oligonucleotide
actaatggtgaaaggaaatt

SEQ ID NO: 1407 - DNA, 20 bp, Artificial sequence
  Synthetic oligonucleotide
agtaaattactaatggtgaa

SEQ ID NO: 1408 - DNA, 20 bp, Artificial sequence
  Synthetic oligonucleotide
cagtaaattactaatggtga

SEQ ID NO: 1409 - DNA, 20 bp, Artificial sequence
  Synthetic oligonucleotide
acagtaaattactaatggtg

SEQ ID NO: 1410 - DNA, 20 bp, Artificial sequence
  Synthetic oligonucleotide
tacagtaaattactaatggt

SEQ ID NO: 1411 - DNA, 20 bp, Artificial sequence
  Synthetic oligonucleotide
ttcagtacctaaaataagtt

SEQ ID NO: 1412 - DNA, 20 bp, Artificial sequence
  Synthetic oligonucleotide
ccctcattttcagtacctaa

SEQ ID NO: 1413 - DNA, 20 bp, Artificial sequence
  Synthetic oligonucleotide
gtataaaacatttagtctcc

SEQ ID NO: 1414 - DNA, 20 bp, Artificial sequence
  Synthetic oligonucleotide
tgtataaaacatttagtctc

SEQ ID NO: 1415 - DNA, 20 bp, Artificial sequence
  Synthetic oligonucleotide
ctgtataaaacatttagtct

SEQ ID NO: 1416 - DNA, 20 bp, Artificial sequence
  Synthetic oligonucleotide
actgtataaaacatttagtc

SEQ ID NO: 1417 - DNA, 20 bp, Artificial sequence
  Synthetic oligonucleotide
aatctcatattttactaaaa

SEQ ID NO: 1418 - DNA, 20 bp, Artificial sequence
  Synthetic oligonucleotide
caaatgcatcaaatctcata

SEQ ID NO: 1419 - DNA, 20 bp, Artificial sequence
  Synthetic oligonucleotide
atcatctatcaaatgcatca

SEQ ID NO: 1420 - DNA, 20 bp, Artificial sequence
  Synthetic oligonucleotide
tattttaaacaaacatcatc

SEQ ID NO: 1421 - DNA, 20 bp, Artificial sequence
  Synthetic oligonucleotide
agaattattttaaacaaaca

SEQ ID NO: 1422 - DNA, 20 bp, Artificial sequence
  Synthetic oligonucleotide
aagaattattttaaacaaac

SEQ ID NO: 1423 - DNA, 20 bp, Artificial sequence
  Synthetic oligonucleotide
tcaaaaatttaagaattatt

SEQ ID NO: 1424 - DNA, 20 bp, Artificial sequence
  Synthetic oligonucleotide
atcaaaaatttaagaattat

SEQ ID NO: 1425 - DNA, 20 bp, Artificial sequence
  Synthetic oligonucleotide
tgatcaaaaatttaagaatt

SEQ ID NO: 1426 - DNA, 20 bp, Artificial sequence
  Synthetic oligonucleotide
atgatcaaaaatttaagaat

SEQ ID NO: 1427 - DNA, 20 bp, Artificial sequence
  Synthetic oligonucleotide
catgatcaaaaatttaagaa

SEQ ID NO: 1428 - DNA, 20 bp, Artificial sequence
  Synthetic oligonucleotide
tacatgatcaaaaatttaag

SEQ ID NO: 1429 - DNA, 20 bp, Artificial sequence
  Synthetic oligonucleotide
ttaatgaaactataattaca

SEQ ID NO: 1430 - DNA, 20 bp, Artificial sequence
  Synthetic oligonucleotide
catgcattttcatttggtaa

SEQ ID NO: 1431 - DNA, 20 bp, Artificial sequence
  Synthetic oligonucleotide
ttgaactgaactttcagctt

SEQ ID NO: 1432 - DNA, 20 bp, Artificial sequence
  Synthetic oligonucleotide
atacggtttcacaatgttag

SEQ ID NO: 1433 - DNA, 20 bp, Artificial sequence
  Synthetic oligonucleotide
ctaaataatttaatcattaa

SEQ ID NO: 1434 - DNA, 20 bp, Artificial sequence
  Synthetic oligonucleotide
ccctaaataatttaatcatt

SEQ ID NO: 1435 - DNA, 20 bp, Artificial sequence
  Synthetic oligonucleotide
tcccctaaataatttaatca

SEQ ID NO: 1436 - DNA, 20 bp, Artificial sequence
  Synthetic oligonucleotide
cggctcccctaaataattta

SEQ ID NO: 1437 - DNA, 20 bp, Artificial sequence
  Synthetic oligonucleotide
atcttcccctaaataatttt

SEQ ID NO: 1438 - DNA, 20 bp, Artificial sequence
  Synthetic oligonucleotide
agaaaaaattaaaatgtgac

SEQ ID NO: 1439 - DNA, 20 bp, Artificial sequence
  Synthetic oligonucleotide
tgctaatatttccaaaagaa

SEQ ID NO: 1440 - DNA, 20 bp, Artificial sequence
  Synthetic oligonucleotide
ttgctaatatttccaaaaga

SEQ ID NO: 1441 - DNA, 20 bp, Artificial sequence
  Synthetic oligonucleotide
aaagtgagccttcttgctaa

SEQ ID NO: 1442 - DNA, 20 bp, Artificial sequence
  Synthetic oligonucleotide
agtgagtttaaaatcagtac

SEQ ID NO: 1443 - DNA, 20 bp, Artificial sequence
  Synthetic oligonucleotide
tagtgagtttaaaatcagta

SEQ ID NO: 1444 - DNA, 20 bp, Artificial sequence
  Synthetic oligonucleotide
tatccacatttttaaaagaa

SEQ ID NO: 1445 - DNA, 20 bp, Artificial sequence
  Synthetic oligonucleotide
cagtcagatccctataggaa

SEQ ID NO: 1446 - DNA, 20 bp, Artificial sequence
  Synthetic oligonucleotide
ttcaccagtcagatccctat

SEQ ID NO: 1447 - DNA, 20 bp, Artificial sequence
  Synthetic oligonucleotide
ataattcaccagtcagatcc

SEQ ID NO: 1448 - DNA, 20 bp, Artificial sequence
  Synthetic oligonucleotide
ttataattcaccagtcagat

SEQ ID NO: 1449 - DNA, 20 bp, Artificial sequence
  Synthetic oligonucleotide
gttataattcaccagtcaga

SEQ ID NO: 1450 - DNA, 20 bp, Artificial sequence
  Synthetic oligonucleotide
agttataattcaccagtcag

SEQ ID NO: 1451 - DNA, 20 bp, Artificial sequence
  Synthetic oligonucleotide
cagttataattcaccagtca

SEQ ID NO: 1452 - DNA, 20 bp, Artificial sequence
  Synthetic oligonucleotide
acagttataattcaccagtc

SEQ ID NO: 1453 - DNA, 20 bp, Artificial sequence
  Synthetic oligonucleotide
tcccatttccaaagttaaca

SEQ ID NO: 1454 - DNA, 20 bp, Artificial sequence
  Synthetic oligonucleotide
gtgcatatttaaaacaatat

SEQ ID NO: 1455 - DNA, 20 bp, Artificial sequence
  Synthetic oligonucleotide
aggatacaaactgtcattag

SEQ ID NO: 1456 - DNA, 20 bp, Artificial sequence
  Synthetic oligonucleotide
agaaggatacaaactgtcat

SEQ ID NO: 1457 - DNA, 20 bp, Artificial sequence
  Synthetic oligonucleotide
ctgttaattttgacaggtag

SEQ ID NO: 1458 - DNA, 20 bp, Artificial sequence
  Synthetic oligonucleotide
ctgctgttaattttgacagg

SEQ ID NO: 1459 - DNA, 20 bp, Artificial sequence
  Synthetic oligonucleotide
gactacttacctgaatagag

SEQ ID NO: 1460 - DNA, 20 bp, Artificial sequence
  Synthetic oligonucleotide
cttgtgactacttacctgaa

SEQ ID NO: 1461 - DNA, 20 bp, Artificial sequence
  Synthetic oligonucleotide
tgtaagcaacacatagtaca

SEQ ID NO: 1462 - DNA, 20 bp, Artificial sequence
  Synthetic oligonucleotide
gagtataatctatactctgt

SEQ ID NO: 1463 - DNA, 20 bp, Artificial sequence
  Synthetic oligonucleotide
tatataaaaatctagtactc

SEQ ID NO: 1464 - DNA, 20 bp, Artificial sequence
  Synthetic oligonucleotide
atctatataaaaatctagta

SEQ ID NO: 1465 - DNA, 20 bp, Artificial sequence
  Synthetic oligonucleotide
tatctatataaaaatctagt

SEQ ID NO: 1466 - DNA, 20 bp, Artificial sequence
  Synthetic oligonucleotide
ttcatgtttatctatataaa

SEQ ID NO: 1467 - DNA, 20 bp, Artificial sequence
  Synthetic oligonucleotide
caatcctttcatgtttatct

SEQ ID NO: 1468 - DNA, 20 bp, Artificial sequence
  Synthetic oligonucleotide
tctacaatcctttcatgttt

SEQ ID NO: 1469 - DNA, 20 bp, Artificial sequence
  Synthetic oligonucleotide
ttctacaatcctttcatgtt

SEQ ID NO: 1470 - DNA, 20 bp, Artificial sequence
  Synthetic oligonucleotide
attctacaatcctttcatgt

SEQ ID NO: 1471 - DNA, 20 bp, Artificial sequence
  Synthetic oligonucleotide
aggaatttttaaatgcccca

SEQ ID NO: 1472 - DNA, 20 bp, Artificial sequence
  Synthetic oligonucleotide
aaggaatttttaaatgcccc

SEQ ID NO: 1473 - DNA, 20 bp, Artificial sequence
  Synthetic oligonucleotide
gaaggaatttttaaatgccc

SEQ ID NO: 1474 - DNA, 20 bp, Artificial sequence
  Synthetic oligonucleotide
agaaggaatttttaaatgcc

SEQ ID NO: 1475 - DNA, 20 bp, Artificial sequence
  Synthetic oligonucleotide
taaggttattattagcatcc

SEQ ID NO: 1476 - DNA, 20 bp, Artificial sequence
  Synthetic oligonucleotide
attaaggttattattagcat

SEQ ID NO: 1477 - DNA, 20 bp, Artificial sequence
  Synthetic oligonucleotide
ctcaaatttacccaacagat

SEQ ID NO: 1478 - DNA, 20 bp, Artificial sequence
  Synthetic oligonucleotide
ttttctcaaatttacccaac

SEQ ID NO: 1479 - DNA, 20 bp, Artificial sequence
  Synthetic oligonucleotide
ggctgatttaaaaggatggt

SEQ ID NO: 1480 - DNA, 20 bp, Artificial sequence
  Synthetic oligonucleotide
aggctgatttaaaaggatgg

SEQ ID NO: 1481 - DNA, 20 bp, Artificial sequence
  Synthetic oligonucleotide
ggtaggctgatttaaaagga

SEQ ID NO: 1482 - DNA, 20 bp, Artificial sequence
  Synthetic oligonucleotide
aaggaaatccagtctggtag

SEQ ID NO: 1483 - DNA, 20 bp, Artificial sequence
  Synthetic oligonucleotide
ataaggaaatccagtctggt

SEQ ID NO: 1484 - DNA, 20 bp, Artificial sequence
  Synthetic oligonucleotide
gccacaaaccataataagga

SEQ ID NO: 1485 - DNA, 20 bp, Artificial sequence
  Synthetic oligonucleotide
aaatcaaaagccacaaacca

SEQ ID NO: 1486 - DNA, 20 bp, Artificial sequence
  Synthetic oligonucleotide
agagctatacattaaaaaaa

SEQ ID NO: 1487 - DNA, 20 bp, Artificial sequence
  Synthetic oligonucleotide
caaagaattcaaagagagct

SEQ ID NO: 1488 - DNA, 20 bp, Artificial sequence
  Synthetic oligonucleotide
accaccaaagaattcaaaga

SEQ ID NO: 1489 - DNA, 20 bp, Artificial sequence
  Synthetic oligonucleotide
tataaccaccaaagaattca

SEQ ID NO: 1490 - DNA, 20 bp, Artificial sequence
  Synthetic oligonucleotide
atatataaccaccaaagaat

SEQ ID NO: 1491 - DNA, 20 bp, Artificial sequence
  Synthetic oligonucleotide
atatatataaccaccaaaga

SEQ ID NO: 1492 - DNA, 20 bp, Artificial sequence
  Synthetic oligonucleotide
tacatatatatataaccacc

SEQ ID NO: 1493 - DNA, 20 bp, Artificial sequence
  Synthetic oligonucleotide
agtacatatatatataacca

SEQ ID NO: 1494 - DNA, 20 bp, Artificial sequence
  Synthetic oligonucleotide
cagataaaagaatcttgcga

SEQ ID NO: 1495 - DNA, 20 bp, Artificial sequence
  Synthetic oligonucleotide
ttagaaaaagaatgaaagac

SEQ ID NO: 1496 - DNA, 20 bp, Artificial sequence
  Synthetic oligonucleotide
ctggatacaactcacagtgt

SEQ ID NO: 1497 - DNA, 20 bp, Artificial sequence
  Synthetic oligonucleotide
tgcagtagccattacctgtt

SEQ ID NO: 1498 - DNA, 20 bp, Artificial sequence
  Synthetic oligonucleotide
aacaggcaccaagagcagca

SEQ ID NO: 1499 - DNA, 20 bp, Artificial sequence
  Synthetic oligonucleotide
ggtagccaacaaagaagcaa

SEQ ID NO: 1500 - DNA, 20 bp, Artificial sequence
  Synthetic oligonucleotide
caaggtagccaacaaagaag

SEQ ID NO: 1501 - DNA, 20 bp, Artificial sequence
  Synthetic oligonucleotide
tccaaggtagccaacaaaga

SEQ ID NO: 1502 - DNA, 20 bp, Artificial sequence
  Synthetic oligonucleotide
ctgaaaattcactatctgcc

SEQ ID NO: 1503 - DNA, 20 bp, Artificial sequence
  Synthetic oligonucleotide
tttctgaaaattcactatct

SEQ ID NO: 1504 - DNA, 20 bp, Artificial sequence
  Synthetic oligonucleotide
aaatttctgaaaattcacta

SEQ ID NO: 1505 - DNA, 20 bp, Artificial sequence
  Synthetic oligonucleotide
aaatgcaaacctgtttattt

SEQ ID NO: 1506 - DNA, 20 bp, Artificial sequence
  Synthetic oligonucleotide
ctgggcatttaaactgaagg

SEQ ID NO: 1507 - DNA, 20 bp, Artificial sequence
  Synthetic oligonucleotide
tctaccaaaataagttctcc

SEQ ID NO: 1508 - DNA, 20 bp, Artificial sequence
  Synthetic oligonucleotide
catatctaccaaaataagtt

SEQ ID NO: 1509 - DNA, 20 bp, Artificial sequence
  Synthetic oligonucleotide
aaaattatattcaacttgct

SEQ ID NO: 1510 - DNA, 20 bp, Artificial sequence
  Synthetic oligonucleotide
tgggtgctactttagaaaaa

SEQ ID NO: 1511 - DNA, 20 bp, Artificial sequence
  Synthetic oligonucleotide
gtctactatatacatctgat

SEQ ID NO: 1512 - DNA, 20 bp, Artificial sequence
  Synthetic oligonucleotide
ctagtctactatatacatct

SEQ ID NO: 1513 - DNA, 20 bp, Artificial sequence
  Synthetic oligonucleotide
actagtctactatatacatc

SEQ ID NO: 1514 - DNA, 20 bp, Artificial sequence
  Synthetic oligonucleotide
ttaaaactagtctactatat

SEQ ID NO: 1515 - DNA, 20 bp, Artificial sequence
  Synthetic oligonucleotide
atattctacccataagtgct

SEQ ID NO: 1516 - DNA, 20 bp, Artificial sequence
  Synthetic oligonucleotide
tgtatattctacccataagt

SEQ ID NO: 1517 - DNA, 20 bp, Artificial sequence
  Synthetic oligonucleotide
tcaaaaatccagatgtatat

SEQ ID NO: 1518 - DNA, 20 bp, Artificial sequence
  Synthetic oligonucleotide
cctcaaaaatccagatgtat

SEQ ID NO: 1519 - DNA, 20 bp, Artificial sequence
  Synthetic oligonucleotide
gcctcaaaaatccagatgta

SEQ ID NO: 1520 - DNA, 20 bp, Artificial sequence
  Synthetic oligonucleotide
cacaattcctaaataaaact

SEQ ID NO: 1521 - DNA, 20 bp, Artificial sequence
  Synthetic oligonucleotide
cacacaattcctaaataaaa

SEQ ID NO: 1522 - DNA, 20 bp, Artificial sequence
  Synthetic oligonucleotide
ccagaaaaccacacaattcc

SEQ ID NO: 1523 - DNA, 20 bp, Artificial sequence
  Synthetic oligonucleotide
tccagaaaaccacacaattc

SEQ ID NO: 1524 - DNA, 20 bp, Artificial sequence
  Synthetic oligonucleotide
ttccagaaaaccacacaatt

SEQ ID NO: 1525 - DNA, 20 bp, Artificial sequence
  Synthetic oligonucleotide
atgttccagaaaaccacaca

SEQ ID NO: 1526 - DNA, 20 bp, Artificial sequence
  Synthetic oligonucleotide
gagatgttccagaaaaccac

SEQ ID NO: 1527 - DNA, 20 bp, Artificial sequence
  Synthetic oligonucleotide
agtgcttttcataccaggtc

SEQ ID NO: 1528 - DNA, 20 bp, Artificial sequence
  Synthetic oligonucleotide
gagtgcttttcataccaggt

SEQ ID NO: 1529 - DNA, 20 bp, Artificial sequence
  Synthetic oligonucleotide
cactaaatccataaaaaaaa

SEQ ID NO: 1530 - DNA, 20 bp, Artificial sequence
  Synthetic oligonucleotide
atcactaaatccataaaaaa

SEQ ID NO: 1531 - DNA, 20 bp, Artificial sequence
  Synthetic oligonucleotide
agatatatcactaaatccat

SEQ ID NO: 1532 - DNA, 20 bp, Artificial sequence
  Synthetic oligonucleotide
atagatatatcactaaatcc

SEQ ID NO: 1533 - DNA, 20 bp, Artificial sequence
  Synthetic oligonucleotide
tatagatatatcactaaatc

SEQ ID NO: 1534 - DNA, 20 bp, Artificial sequence
  Synthetic oligonucleotide
tgtgtatagatatatcacta

SEQ ID NO: 1535 - DNA, 20 bp, Artificial sequence
  Synthetic oligonucleotide
gtgtgtatagatatatcact

SEQ ID NO: 1536 - DNA, 20 bp, Artificial sequence
  Synthetic oligonucleotide
tataggttttaaaaagtgtg

SEQ ID NO: 1537 - DNA, 20 bp, Artificial sequence
  Synthetic oligonucleotide
tataaatttctctagaaggc

SEQ ID NO: 1538 - DNA, 20 bp, Artificial sequence
  Synthetic oligonucleotide
atataaatttctctagaagg

SEQ ID NO: 1539 - DNA, 20 bp, Artificial sequence
  Synthetic oligonucleotide
tcatatataaatttctctag

SEQ ID NO: 1540 - DNA, 20 bp, Artificial sequence
  Synthetic oligonucleotide
ccattccaaatttaggaagt

SEQ ID NO: 1541 - DNA, 20 bp, Artificial sequence
  Synthetic oligonucleotide
actccattccaaatttagga

SEQ ID NO: 1542 - DNA, 20 bp, Artificial sequence
  Synthetic oligonucleotide
agcaacttttcataagctaa

SEQ ID NO: 1543 - DNA, 20 bp, Artificial sequence
  Synthetic oligonucleotide
tgcttataacctgttaagaa

SEQ ID NO: 1544 - DNA, 20 bp, Artificial sequence
  Synthetic oligonucleotide
gaaatgcaaaacagaatctt

SEQ ID NO: 1545 - DNA, 20 bp, Artificial sequence
  Synthetic oligonucleotide
ttacaactttaaaaatcaaa

SEQ ID NO: 1546 - DNA, 20 bp, Artificial sequence
  Synthetic oligonucleotide
tttaagaaattacaacttta

SEQ ID NO: 1547 - DNA, 20 bp, Artificial sequence
  Synthetic oligonucleotide
agtattcaaaatgtatttct

SEQ ID NO: 1548 - DNA, 20 bp, Artificial sequence
  Synthetic oligonucleotide
gaacatcaaaacaaaagtat

SEQ ID NO: 1549 - DNA, 20 bp, Artificial sequence
  Synthetic oligonucleotide
cacaaaggtgaaataggaaa

SEQ ID NO: 1550 - DNA, 20 bp, Artificial sequence
  Synthetic oligonucleotide
atcacacaaccatatgaacg

SEQ ID NO: 1551 - DNA, 20 bp, Artificial sequence
  Synthetic oligonucleotide
ttttaaaagatcacacaacc

SEQ ID NO: 1552 - DNA, 20 bp, Artificial sequence
  Synthetic oligonucleotide
gtttttaaaagatcacacaa

SEQ ID NO: 1553 - DNA, 20 bp, Artificial sequence
  Synthetic oligonucleotide
gatgtttttaaaagatcaca

SEQ ID NO: 1554 - DNA, 20 bp, Artificial sequence
  Synthetic oligonucleotide
actgatgtttttaaaagatc

SEQ ID NO: 1555 - DNA, 20 bp, Artificial sequence
  Synthetic oligonucleotide
cactgatgtttttaaaagat

SEQ ID NO: 1556 - DNA, 20 bp, Artificial sequence
  Synthetic oligonucleotide
aagattatatttatagttaa

SEQ ID NO: 1557 - DNA, 20 bp, Artificial sequence
  Synthetic oligonucleotide
taagattatatttatagtta

SEQ ID NO: 1558 - DNA, 20 bp, Artificial sequence
  Synthetic oligonucleotide
gtgataatttaagattatat

SEQ ID NO: 1559 - DNA, 20 bp, Artificial sequence
  Synthetic oligonucleotide
tttgtgataatttaagatta

SEQ ID NO: 1560 - DNA, 20 bp, Artificial sequence
  Synthetic oligonucleotide
aaaatttgtgataatttaag

SEQ ID NO: 1561 - DNA, 20 bp, Artificial sequence
  Synthetic oligonucleotide
gcaaatattatataaaattt

SEQ ID NO: 1562 - DNA, 20 bp, Artificial sequence
  Synthetic oligonucleotide
tggcaaatattatataaaat

SEQ ID NO: 1563 - DNA, 20 bp, Artificial sequence
  Synthetic oligonucleotide
tgaattcatatttatgttgt

SEQ ID NO: 1564 - DNA, 20 bp, Artificial sequence
  Synthetic oligonucleotide
cttgaaatattgaattcata

SEQ ID NO: 1565 - DNA, 20 bp, Artificial sequence
  Synthetic oligonucleotide
gaaaacagacaatattaact

SEQ ID NO: 1566 - DNA, 20 bp, Artificial sequence
  Synthetic oligonucleotide
taaatgatctttcatttcta

SEQ ID NO: 1567 - DNA, 20 bp, Artificial sequence
  Synthetic oligonucleotide
acctgttttcctaattttct

SEQ ID NO: 1568 - DNA, 20 bp, Artificial sequence
  Synthetic oligonucleotide
aagggtaagaaatgttacct

SEQ ID NO: 1569 - DNA, 20 bp, Artificial sequence
  Synthetic oligonucleotide
tataagaaaaaaagacaagg

SEQ ID NO: 1570 - DNA, 20 bp, Artificial sequence
  Synthetic oligonucleotide
caatataagaaaaaaagaca

SEQ ID NO: 1571 - DNA, 20 bp, Artificial sequence
  Synthetic oligonucleotide
tggcccacattttagtttta

SEQ ID NO: 1572 - DNA, 20 bp, Artificial sequence
  Synthetic oligonucleotide
aattttaaagtcagcaatcc

SEQ ID NO: 1573 - DNA, 20 bp, Artificial sequence
  Synthetic oligonucleotide
tcctaattttaaagtcagca

SEQ ID NO: 1574 - DNA, 20 bp, Artificial sequence
  Synthetic oligonucleotide
ttcctaattttaaagtcagc

SEQ ID NO: 1575 - DNA, 20 bp, Artificial sequence
  Synthetic oligonucleotide
tttcctaattttaaagtcag

SEQ ID NO: 1576 - DNA, 20 bp, Artificial sequence
  Synthetic oligonucleotide
gtttcctaattttaaagtca

SEQ ID NO: 1577 - DNA, 20 bp, Artificial sequence
  Synthetic oligonucleotide
ggtcagtttcctaattttaa

SEQ ID NO: 1578 - DNA, 20 bp, Artificial sequence
  Synthetic oligonucleotide
aatgacaatttctatctatc

SEQ ID NO: 1579 - DNA, 20 bp, Artificial sequence
  Synthetic oligonucleotide
gatattatcttttaaaatga

SEQ ID NO: 1580 - DNA, 20 bp, Artificial sequence
  Synthetic oligonucleotide
cacaaataaatttataagga

SEQ ID NO: 1581 - DNA, 20 bp, Artificial sequence
  Synthetic oligonucleotide
acttgtcacaaataaattta

SEQ ID NO: 1582 - DNA, 20 bp, Artificial sequence
  Synthetic oligonucleotide
tacttgtcacaaataaattt

SEQ ID NO: 1583 - DNA, 20 bp, Artificial sequence
  Synthetic oligonucleotide
atagttaaattgcatatact

SEQ ID NO: 1584 - DNA, 20 bp, Artificial sequence
  Synthetic oligonucleotide
tgatatagttaaattgcata

SEQ ID NO: 1585 - DNA, 20 bp, Artificial sequence
  Synthetic oligonucleotide
ttttcttatgatatagttaa

SEQ ID NO: 1586 - DNA, 20 bp, Artificial sequence
  Synthetic oligonucleotide
tagaatttttcttatgatat

SEQ ID NO: 1587 - DNA, 20 bp, Artificial sequence
  Synthetic oligonucleotide
atagaatttttcttatgata

SEQ ID NO: 1588 - DNA, 20 bp, Artificial sequence
  Synthetic oligonucleotide
taatatagaatttttcttat

SEQ ID NO: 1589 - DNA, 20 bp, Artificial sequence
  Synthetic oligonucleotide
ttgtattatctttaatatag

SEQ ID NO: 1590 - DNA, 20 bp, Artificial sequence
  Synthetic oligonucleotide
acataaaaacccacttaaaa

SEQ ID NO: 1591 - DNA, 20 bp, Artificial sequence
  Synthetic oligonucleotide
catcacataaaaacccactt

SEQ ID NO: 1592 - DNA, 20 bp, Artificial sequence
  Synthetic oligonucleotide
gaacatagtcatcacataaa

SEQ ID NO: 1593 - DNA, 20 bp, Artificial sequence
  Synthetic oligonucleotide
cagaacatagtcatcacata

SEQ ID NO: 1594 - DNA, 20 bp, Artificial sequence
  Synthetic oligonucleotide
tgctaaatacaaatctataa

SEQ ID NO: 1595 - DNA, 20 bp, Artificial sequence
  Synthetic oligonucleotide
tatgctaaatacaaatctat

SEQ ID NO: 1596 - DNA, 20 bp, Artificial sequence
  Synthetic oligonucleotide
ctatgctaaatacaaatcta

SEQ ID NO: 1597 - DNA, 20 bp, Artificial sequence
  Synthetic oligonucleotide
actatgctaaatacaaatct

SEQ ID NO: 1598 - DNA, 20 bp, Artificial sequence
  Synthetic oligonucleotide
acactatttcaggctttgtg

SEQ ID NO: 1599 - DNA, 20 bp, Artificial sequence
  Synthetic oligonucleotide
atgctttattcatgcttgac

SEQ ID NO: 1600 - DNA, 20 bp, Artificial sequence
  Synthetic oligonucleotide
ataatcttacactaaagcaa

SEQ ID NO: 1601 - DNA, 20 bp, Artificial sequence
  Synthetic oligonucleotide
tgaataatcttacactaaag

SEQ ID NO: 1602 - DNA, 20 bp, Artificial sequence
  Synthetic oligonucleotide
atgaataatcttacactaaa

SEQ ID NO: 1603 - DNA, 20 bp, Artificial sequence
  Synthetic oligonucleotide
aatcataatgaataatctta

SEQ ID NO: 1604 - DNA, 20 bp, Artificial sequence
  Synthetic oligonucleotide
agacatatttcatgttttat

SEQ ID NO: 1605 - DNA, 20 bp, Artificial sequence
  Synthetic oligonucleotide
aagacatatttcatgtttta

SEQ ID NO: 1606 - DNA, 20 bp, Artificial sequence
  Synthetic oligonucleotide
caagacatatttcatgtttt

SEQ ID NO: 1607 - DNA, 20 bp, Artificial sequence
  Synthetic oligonucleotide
ttgctcaagacatatttcat

SEQ ID NO: 1608 - DNA, 20 bp, Artificial sequence
  Synthetic oligonucleotide
cttgctcaagacatatttca

SEQ ID NO: 1609 - DNA, 20 bp, Artificial sequence
  Synthetic oligonucleotide
tgtttcttaaaatagcttgc

SEQ ID NO: 1610 - DNA, 20 bp, Artificial sequence
  Synthetic oligonucleotide
ttcaaaattctaataacaag

SEQ ID NO: 1611 - DNA, 20 bp, Artificial sequence
  Synthetic oligonucleotide
agattcaaaattctaataac

SEQ ID NO: 1612 - DNA, 20 bp, Artificial sequence
  Synthetic oligonucleotide
ctctttcaaagattcaaaat

SEQ ID NO: 1613 - DNA, 20 bp, Artificial sequence
  Synthetic oligonucleotide
accctctttcaaagattcaa

SEQ ID NO: 1614 - DNA, 20 bp, Artificial sequence
  Synthetic oligonucleotide
ttcaataaccctctttcaaa

SEQ ID NO: 1615 - DNA, 20 bp, Artificial sequence
  Synthetic oligonucleotide
taaatgataccatacagcag

SEQ ID NO: 1616 - DNA, 20 bp, Artificial sequence
  Synthetic oligonucleotide
ttaataaatgataccataca

SEQ ID NO: 1617 - DNA, 20 bp, Artificial sequence
  Synthetic oligonucleotide
tttctagacttttaataaat

SEQ ID NO: 1618 - DNA, 20 bp, Artificial sequence
  Synthetic oligonucleotide
tactacaaccaagatagtga

SEQ ID NO: 1619 - DNA, 20 bp, Artificial sequence
  Synthetic oligonucleotide
tactgtactcccatgaaacc

SEQ ID NO: 1620 - DNA, 20 bp, Artificial sequence
  Synthetic oligonucleotide
catttgtatactgtactccc

SEQ ID NO: 1621 - DNA, 20 bp, Artificial sequence
  Synthetic oligonucleotide
ttggcttgtatttacatttt

SEQ ID NO: 1622 - DNA, 20 bp, Artificial sequence
  Synthetic oligonucleotide
agatttaattcaatatattt

SEQ ID NO: 1623 - DNA, 20 bp, Artificial sequence
  Synthetic oligonucleotide
ctcttacagatttaattcaa

SEQ ID NO: 1624 - DNA, 20 bp, Artificial sequence
  Synthetic oligonucleotide
tgtttttgaattatctctta

SEQ ID NO: 1625 - DNA, 20 bp, Artificial sequence
  Synthetic oligonucleotide
aaaagataacaatagggttt

SEQ ID NO: 1626 - DNA, 20 bp, Artificial sequence
  Synthetic oligonucleotide
taaaagataacaatagggtt

SEQ ID NO: 1627 - DNA, 20 bp, Artificial sequence
  Synthetic oligonucleotide
acttaaaagataacaatagg

SEQ ID NO: 1628 - DNA, 20 bp, Artificial sequence
  Synthetic oligonucleotide
tgacttaaaagataacaata

SEQ ID NO: 1629 - DNA, 20 bp, Artificial sequence
  Synthetic oligonucleotide
tgggtgacttaaaagataac

SEQ ID NO: 1630 - DNA, 20 bp, Artificial sequence
  Synthetic oligonucleotide
atttgggtgacttaaaagat

SEQ ID NO: 1631 - DNA, 20 bp, Artificial sequence
  Synthetic oligonucleotide
gacttttcccaaatttgatt

SEQ ID NO: 1632 - DNA, 20 bp, Artificial sequence
  Synthetic oligonucleotide
gtgacttttcccaaatttga

SEQ ID NO: 1633 - DNA, 20 bp, Artificial sequence
  Synthetic oligonucleotide
ttaagaaagaaccaacttag

SEQ ID NO: 1634 - DNA, 20 bp, Artificial sequence
  Synthetic oligonucleotide
caggaagaactttaagaaag

SEQ ID NO: 1635 - DNA, 20 bp, Artificial sequence
  Synthetic oligonucleotide
gttacatctccttaacttgc

SEQ ID NO: 1636 - DNA, 20 bp, Artificial sequence
  Synthetic oligonucleotide
ccagctagcctccactgtaa

SEQ ID NO: 1637 - DNA, 20 bp, Artificial sequence
  Synthetic oligonucleotide
acccagctagcctccactgt

SEQ ID NO: 1638 - DNA, 20 bp, Artificial sequence
  Synthetic oligonucleotide
ttaaataatctcagcagtac

SEQ ID NO: 1639 - DNA, 20 bp, Artificial sequence
  Synthetic oligonucleotide
gaggttaaataatctcagca

SEQ ID NO: 1640 - DNA, 20 bp, Artificial sequence
  Synthetic oligonucleotide
agaggttaaataatctcagc

SEQ ID NO: 1641 - DNA, 20 bp, Artificial sequence
  Synthetic oligonucleotide
cagaggttaaataatctcag

SEQ ID NO: 1642 - DNA, 20 bp, Artificial sequence
  Synthetic oligonucleotide
ccagaggttaaataatctca

SEQ ID NO: 1643 - DNA, 20 bp, Artificial sequence
  Synthetic oligonucleotide
cccagaggttaaataatctc

SEQ ID NO: 1644 - DNA, 20 bp, Artificial sequence
  Synthetic oligonucleotide
aaataaaacccagaggttaa

SEQ ID NO: 1645 - DNA, 20 bp, Artificial sequence
  Synthetic oligonucleotide
taaataaaacccagaggtta

SEQ ID NO: 1646 - DNA, 20 bp, Artificial sequence
  Synthetic oligonucleotide
ataaataaaacccagaggtt

SEQ ID NO: 1647 - DNA, 20 bp, Artificial sequence
  Synthetic oligonucleotide
gcttactttatacaaaaaaa

SEQ ID NO: 1648 - DNA, 20 bp, Artificial sequence
  Synthetic oligonucleotide
gtgcttactttatacaaaaa

SEQ ID NO: 1649 - DNA, 20 bp, Artificial sequence
  Synthetic oligonucleotide
cagtgcttactttatacaaa

SEQ ID NO: 1650 - DNA, 20 bp, Artificial sequence
  Synthetic oligonucleotide
ccttaaaaattcagtgctta

SEQ ID NO: 1651 - DNA, 20 bp, Artificial sequence
  Synthetic oligonucleotide
accttaaaaattcagtgctt

SEQ ID NO: 1652 - DNA, 20 bp, Artificial sequence
  Synthetic oligonucleotide
ttaatacaaccttaaaaatt

SEQ ID NO: 1653 - DNA, 20 bp, Artificial sequence
  Synthetic oligonucleotide
tgcaaattaatacaacctta

SEQ ID NO: 1654 - DNA, 20 bp, Artificial sequence
  Synthetic oligonucleotide
gacatttatttgcaaattaa

SEQ ID NO: 1655 - DNA, 20 bp, Artificial sequence
  Synthetic oligonucleotide
aagatagacatttatttgca

SEQ ID NO: 1656 - DNA, 20 bp, Artificial sequence
  Synthetic oligonucleotide
taagatagacatttatttgc

SEQ ID NO: 1657 - DNA, 20 bp, Artificial sequence
  Synthetic oligonucleotide
aataagatagacatttattt

SEQ ID NO: 1658 - DNA, 20 bp, Artificial sequence
  Synthetic oligonucleotide
aaaataataagatagacatt

SEQ ID NO: 1659 - DNA, 20 bp, Artificial sequence
  Synthetic oligonucleotide
ctcaaaataataagatagac

SEQ ID NO: 1660 - DNA, 20 bp, Artificial sequence
  Synthetic oligonucleotide
tctcaaaataataagataga

SEQ ID NO: 1661 - DNA, 20 bp, Artificial sequence
  Synthetic oligonucleotide
ctctcaaaataataagatag

SEQ ID NO: 1662 - DNA, 20 bp, Artificial sequence
  Synthetic oligonucleotide
aaaattttttaaatctctca

SEQ ID NO: 1663 - DNA, 20 bp, Artificial sequence
  Synthetic oligonucleotide
tcaaaatgtgaaaatgcaat

SEQ ID NO: 1664 - DNA, 20 bp, Artificial sequence
  Synthetic oligonucleotide
aaccaaaatttgacatcttc

SEQ ID NO: 1665 - DNA, 20 bp, Artificial sequence
  Synthetic oligonucleotide
ataaaccaaaatttgacatc

SEQ ID NO: 1666 - DNA, 20 bp, Artificial sequence
  Synthetic oligonucleotide
aaaataaaccaaaatttgac

SEQ ID NO: 1667 - DNA, 20 bp, Artificial sequence
  Synthetic oligonucleotide
atagtgaaaaatatagtttt

SEQ ID NO: 1668 - DNA, 20 bp, Artificial sequence
  Synthetic oligonucleotide
ctatagtgaaaaatatagtt

SEQ ID NO: 1669 - DNA, 20 bp, Artificial sequence
  Synthetic oligonucleotide
gtctatagtgaaaaatatag

SEQ ID NO: 1670 - DNA, 20 bp, Artificial sequence
  Synthetic oligonucleotide
ttcattatacagggacctcg

SEQ ID NO: 1671 - DNA, 20 bp, Artificial sequence
  Synthetic oligonucleotide
cttctttttcattatacagg

SEQ ID NO: 1672 - DNA, 20 bp, Artificial sequence
  Synthetic oligonucleotide
taatactttttccagccttc

SEQ ID NO: 1673 - DNA, 20 bp, Artificial sequence
  Synthetic oligonucleotide
gttaatactttttccagcct

SEQ ID NO: 1674 - DNA, 20 bp, Artificial sequence
  Synthetic oligonucleotide
atgttaatactttttccagc

SEQ ID NO: 1675 - DNA, 20 bp, Artificial sequence
  Synthetic oligonucleotide
aatgttaatactttttccag

SEQ ID NO: 1676 - DNA, 20 bp, Artificial sequence
  Synthetic oligonucleotide
acaatgttaatactttttcc

SEQ ID NO: 1677 - DNA, 20 bp, Artificial sequence
  Synthetic oligonucleotide
ggattttgacaatgttaata

SEQ ID NO: 1678 - DNA, 20 bp, Artificial sequence
  Synthetic oligonucleotide
cgatcaatatcatgaccaac

SEQ ID NO: 1679 - DNA, 20 bp, Artificial sequence
  Synthetic oligonucleotide
aaaaagtttctaaagttaac

SEQ ID NO: 1680 - DNA, 20 bp, Artificial sequence
  Synthetic oligonucleotide
cacaagatacaaaaagtttc

SEQ ID NO: 1681 - DNA, 20 bp, Artificial sequence
  Synthetic oligonucleotide
acccacaagatacaaaaagt

SEQ ID NO: 1682 - DNA, 20 bp, Artificial sequence
  Synthetic oligonucleotide
aacccacaagatacaaaaag

SEQ ID NO: 1683 - DNA, 20 bp, Artificial sequence
  Synthetic oligonucleotide
taacccacaagatacaaaaa

SEQ ID NO: 1684 - DNA, 20 bp, Artificial sequence
  Synthetic oligonucleotide
taatttaacccacaagatac

SEQ ID NO: 1685 - DNA, 20 bp, Artificial sequence
  Synthetic oligonucleotide
ctaatttaacccacaagata

SEQ ID NO: 1686 - DNA, 20 bp, Artificial sequence
  Synthetic oligonucleotide
aatcctaatttaacccacaa

SEQ ID NO: 1687 - DNA, 20 bp, Artificial sequence
  Synthetic oligonucleotide
gtaatcctaatttaacccac

SEQ ID NO: 1688 - DNA, 20 bp, Artificial sequence
  Synthetic oligonucleotide
catagtaatcctaatttaac

SEQ ID NO: 1689 - DNA, 20 bp, Artificial sequence
  Synthetic oligonucleotide
tcatttatcactaccacata

SEQ ID NO: 1690 - DNA, 20 bp, Artificial sequence
  Synthetic oligonucleotide
acatcatttatcactaccac

SEQ ID NO: 1691 - DNA, 20 bp, Artificial sequence
  Synthetic oligonucleotide
attaacatcatttatcacta

SEQ ID NO: 1692 - DNA, 20 bp, Artificial sequence
  Synthetic oligonucleotide
ctaattaacatcatttatca

SEQ ID NO: 1693 - DNA, 20 bp, Artificial sequence
  Synthetic oligonucleotide
cctaattaacatcatttatc

SEQ ID NO: 1694 - DNA, 20 bp, Artificial sequence
  Synthetic oligonucleotide
ccctaattaacatcatttat

SEQ ID NO: 1695 - DNA, 20 bp, Artificial sequence
  Synthetic oligonucleotide
gccctaattaacatcattta

SEQ ID NO: 1696 - DNA, 20 bp, Artificial sequence
  Synthetic oligonucleotide
cggccctaattaacatcatt

SEQ ID NO: 1697 - DNA, 20 bp, Artificial sequence
  Synthetic oligonucleotide
tcggccctaattaacatcat

SEQ ID NO: 1698 - DNA, 20 bp, Artificial sequence
  Synthetic oligonucleotide
ctcggccctaattaacatca

SEQ ID NO: 1699 - DNA, 20 bp, Artificial sequence
  Synthetic oligonucleotide
tgcactcggccctaattaac

SEQ ID NO: 1700 - DNA, 20 bp, Artificial sequence
  Synthetic oligonucleotide
ggtcttacactatgttgtac

SEQ ID NO: 1701 - DNA, 20 bp, Artificial sequence
  Synthetic oligonucleotide
cacatataacatataaacac

SEQ ID NO: 1702 - DNA, 20 bp, Artificial sequence
  Synthetic oligonucleotide
atcacatataacatataaac

SEQ ID NO: 1703 - DNA, 20 bp, Artificial sequence
  Synthetic oligonucleotide
cactatcacatataacatat

SEQ ID NO: 1704 - DNA, 20 bp, Artificial sequence
  Synthetic oligonucleotide
gtctctataatttaaaaatg

SEQ ID NO: 1705 - DNA, 20 bp, Artificial sequence
  Synthetic oligonucleotide
cagctcagtttttaaaaatc

SEQ ID NO: 1706 - DNA, 20 bp, Artificial sequence
  Synthetic oligonucleotide
tttataattaccagctcagt

SEQ ID NO: 1707 - DNA, 20 bp, Artificial sequence
  Synthetic oligonucleotide
gaatttataattaccagctc

SEQ ID NO: 1708 - DNA, 20 bp, Artificial sequence
  Synthetic oligonucleotide
aggaagagaatttataatta

SEQ ID NO: 1709 - DNA, 20 bp, Artificial sequence
  Synthetic oligonucleotide
tgtgagaaagtcagaagttc

SEQ ID NO: 1710 - DNA, 20 bp, Artificial sequence
  Synthetic oligonucleotide
tgtcaaaagattccaattgt

SEQ ID NO: 1711 - DNA, 20 bp, Artificial sequence
  Synthetic oligonucleotide
tttgtcaaaagattccaatt

SEQ ID NO: 1712 - DNA, 20 bp, Artificial sequence
  Synthetic oligonucleotide
aatttttgtcaaaagattcc

SEQ ID NO: 1713 - DNA, 20 bp, Artificial sequence
  Synthetic oligonucleotide
aagttttcccattactgata

SEQ ID NO: 1714 - DNA, 20 bp, Artificial sequence
  Synthetic oligonucleotide
aaatgacaactacacaaagt

SEQ ID NO: 1715 - DNA, 20 bp, Artificial sequence
  Synthetic oligonucleotide
caacataactccaatcatat

SEQ ID NO: 1716 - DNA, 20 bp, Artificial sequence
  Synthetic oligonucleotide
tttttcaaaatatcagtcca

SEQ ID NO: 1717 - DNA, 20 bp, Artificial sequence
  Synthetic oligonucleotide
ttttttcaaaatatcagtcc

SEQ ID NO: 1718 - DNA, 20 bp, Artificial sequence
  Synthetic oligonucleotide
agctataattaaatcttttt

SEQ ID NO: 1719 - DNA, 20 bp, Artificial sequence
  Synthetic oligonucleotide
aatgtctttattaatagcta

SEQ ID NO: 1720 - DNA, 20 bp, Artificial sequence
  Synthetic oligonucleotide
aaatgtctttattaatagct

SEQ ID NO: 1721 - DNA, 20 bp, Artificial sequence
  Synthetic oligonucleotide
tcagtagtttaaatgtcttt

SEQ ID NO: 1722 - DNA, 20 bp, Artificial sequence
  Synthetic oligonucleotide
ctcccaaaagaataaaaatg

SEQ ID NO: 1723 - DNA, 20 bp, Artificial sequence
  Synthetic oligonucleotide
aaaccctcccaaaagaataa

SEQ ID NO: 1724 - DNA, 20 bp, Artificial sequence
  Synthetic oligonucleotide
acattaaaccctcccaaaag

SEQ ID NO: 1725 - DNA, 20 bp, Artificial sequence
  Synthetic oligonucleotide
aacattaaaccctcccaaaa

SEQ ID NO: 1726 - DNA, 20 bp, Artificial sequence
  Synthetic oligonucleotide
tataaacattaaaccctccc

SEQ ID NO: 1727 - DNA, 20 bp, Artificial sequence
  Synthetic oligonucleotide
actataaacattaaaccctc

SEQ ID NO: 1728 - DNA, 20 bp, Artificial sequence
  Synthetic oligonucleotide
aactataaacattaaaccct

SEQ ID NO: 1729 - DNA, 20 bp, Artificial sequence
  Synthetic oligonucleotide
tttaaactataaacattaaa

SEQ ID NO: 1730 - DNA, 20 bp, Artificial sequence
  Synthetic oligonucleotide
tgctttaaactataaacatt

SEQ ID NO: 1731 - DNA, 20 bp, Artificial sequence
  Synthetic oligonucleotide
ttgctttaaactataaacat

SEQ ID NO: 1732 - DNA, 20 bp, Artificial sequence
  Synthetic oligonucleotide
tttgctttaaactataaaca

SEQ ID NO: 1733 - DNA, 20 bp, Artificial sequence
  Synthetic oligonucleotide
agtttgctttaaactataaa

SEQ ID NO: 1734 - DNA, 20 bp, Artificial sequence
  Synthetic oligonucleotide
tatcactattaaatactttt

SEQ ID NO: 1735 - DNA, 20 bp, Artificial sequence
  Synthetic oligonucleotide
atactgcagatttatcacta

SEQ ID NO: 1736 - DNA, 20 bp, Artificial sequence
  Synthetic oligonucleotide
gactgaataatatgatctta

SEQ ID NO: 1737 - DNA, 20 bp, Artificial sequence
  Synthetic oligonucleotide
gaaatatttcaagttgagct

SEQ ID NO: 1738 - DNA, 20 bp, Artificial sequence
  Synthetic oligonucleotide
tggaaatatttcaagttgag

SEQ ID NO: 1739 - DNA, 20 bp, Artificial sequence
  Synthetic oligonucleotide
ctggaaatatttcaagttga

SEQ ID NO: 1740 - DNA, 20 bp, Artificial sequence
  Synthetic oligonucleotide
tctggaaatatttcaagttg

SEQ ID NO: 1741 - DNA, 20 bp, Artificial sequence
  Synthetic oligonucleotide
aagattgtttaaactctgga

SEQ ID NO: 1742 - DNA, 20 bp, Artificial sequence
  Synthetic oligonucleotide
agatacaacccatcaaagct

SEQ ID NO: 1743 - DNA, 20 bp, Artificial sequence
  Synthetic oligonucleotide
tagatacaacccatcaaagc

SEQ ID NO: 1744 - DNA, 20 bp, Artificial sequence
  Synthetic oligonucleotide
ttaagaatagatacaaccca

SEQ ID NO: 1745 - DNA, 20 bp, Artificial sequence
  Synthetic oligonucleotide
acatgttaagaatagataca

SEQ ID NO: 1746 - DNA, 20 bp, Artificial sequence
  Synthetic oligonucleotide
aggaagtttcacatgttaag

SEQ ID NO: 1747 - DNA, 20 bp, Artificial sequence
  Synthetic oligonucleotide
tgtcaatatttaagttagtg

SEQ ID NO: 1748 - DNA, 20 bp, Artificial sequence
  Synthetic oligonucleotide
ttgtcaatatttaagttagt

SEQ ID NO: 1749 - DNA, 20 bp, Artificial sequence
  Synthetic oligonucleotide
attgtcaatatttaagttag

SEQ ID NO: 1750 - DNA, 20 bp, Artificial sequence
  Synthetic oligonucleotide
ttcaagttaaaccactggaa

SEQ ID NO: 1751 - DNA, 20 bp, Artificial sequence
  Synthetic oligonucleotide
aattcaagttaaaccactgg

SEQ ID NO: 1752 - DNA, 20 bp, Artificial sequence
  Synthetic oligonucleotide
ttacttaccttcctgttgta

SEQ ID NO: 1753 - DNA, 20 bp, Artificial sequence
  Synthetic oligonucleotide
gtaacattacaaaatgttca

SEQ ID NO: 1754 - DNA, 20 bp, Artificial sequence
  Synthetic oligonucleotide
ttatttaactacttcgaaag

SEQ ID NO: 1755 - DNA, 20 bp, Artificial sequence
  Synthetic oligonucleotide
tgcctggttatttaactact

SEQ ID NO: 1756 - DNA, 20 bp, Artificial sequence
  Synthetic oligonucleotide
caaatcacagcctatcacca

SEQ ID NO: 1757 - DNA, 20 bp, Artificial sequence
  Synthetic oligonucleotide
cacccaaatcacagcctatc

SEQ ID NO: 1758 - DNA, 20 bp, Artificial sequence
  Synthetic oligonucleotide
tcacccaaatcacagcctat

SEQ ID NO: 1759 - DNA, 20 bp, Artificial sequence
  Synthetic oligonucleotide
gtcacccaaatcacagccta

SEQ ID NO: 1760 - DNA, 20 bp, Artificial sequence
  Synthetic oligonucleotide
agaaaaagccattacttaga

SEQ ID NO: 1761 - DNA, 20 bp, Artificial sequence
  Synthetic oligonucleotide
aaagaaaaagccattactta

SEQ ID NO: 1762 - DNA, 20 bp, Artificial sequence
  Synthetic oligonucleotide
catgtatttcaaagaaactg

SEQ ID NO: 1763 - DNA, 20 bp, Artificial sequence
  Synthetic oligonucleotide
caagggatagtttaatctag

SEQ ID NO: 1764 - DNA, 20 bp, Artificial sequence
  Synthetic oligonucleotide
gatcctaaaatcactgatga

SEQ ID NO: 1765 - DNA, 20 bp, Artificial sequence
  Synthetic oligonucleotide
agatcctaaaatcactgatg

SEQ ID NO: 1766 - DNA, 20 bp, Artificial sequence
  Synthetic oligonucleotide
tcagatcctaaaatcactga

SEQ ID NO: 1767 - DNA, 20 bp, Artificial sequence
  Synthetic oligonucleotide
gtcagatcctaaaatcactg

SEQ ID NO: 1768 - DNA, 20 bp, Artificial sequence
  Synthetic oligonucleotide
agtcagatcctaaaatcact

SEQ ID NO: 1769 - DNA, 20 bp, Artificial sequence
  Synthetic oligonucleotide
gacgatacagaaataattaa

SEQ ID NO: 1770 - DNA, 20 bp, Artificial sequence
  Synthetic oligonucleotide
aacatggtttaaagatagga

SEQ ID NO: 1771 - DNA, 20 bp, Artificial sequence
  Synthetic oligonucleotide
aacagacaaaacatggttta

SEQ ID NO: 1772 - DNA, 20 bp, Artificial sequence
  Synthetic oligonucleotide
gggtttaaagaatggctgga

SEQ ID NO: 1773 - DNA, 20 bp, Artificial sequence
  Synthetic oligonucleotide
agtagggtttaaagaatggc

SEQ ID NO: 1774 - DNA, 20 bp, Artificial sequence
  Synthetic oligonucleotide
caatggagtgattatgatga

SEQ ID NO: 1775 - DNA, 20 bp, Artificial sequence
  Synthetic oligonucleotide
tttgtcattcaagtatgatg

SEQ ID NO: 1776 - DNA, 20 bp, Artificial sequence
  Synthetic oligonucleotide
tggtttaaccagggttgaga

SEQ ID NO: 1777 - DNA, 20 bp, Artificial sequence
  Synthetic oligonucleotide
tatgttattttttagccacg

SEQ ID NO: 1778 - DNA, 20 bp, Artificial sequence
  Synthetic oligonucleotide
tttatgttattttttagcca

SEQ ID NO: 1779 - DNA, 20 bp, Artificial sequence
  Synthetic oligonucleotide
aaaccaatcatcatgtttta

SEQ ID NO: 1780 - DNA, 20 bp, Artificial sequence
  Synthetic oligonucleotide
aaaaccaatcatcatgtttt

SEQ ID NO: 1781 - DNA, 20 bp, Artificial sequence
  Synthetic oligonucleotide
taaaaccaatcatcatgttt

SEQ ID NO: 1782 - DNA, 20 bp, Artificial sequence
  Synthetic oligonucleotide
aaagtaaaaccaatcatcat

SEQ ID NO: 1783 - DNA, 20 bp, Artificial sequence
  Synthetic oligonucleotide
ggatagatcatttaagaaaa

SEQ ID NO: 1784 - DNA, 20 bp, Artificial sequence
  Synthetic oligonucleotide
atgagctgtgattatgctgc

SEQ ID NO: 1785 - DNA, 20 bp, Artificial sequence
  Synthetic oligonucleotide
aaagtaaaaccttagctagg

SEQ ID NO: 1786 - DNA, 20 bp, Artificial sequence
  Synthetic oligonucleotide
taaagtaaaaccttagctag

SEQ ID NO: 1787 - DNA, 20 bp, Artificial sequence
  Synthetic oligonucleotide
atttaaagtaaaaccttagc

SEQ ID NO: 1788 - DNA, 20 bp, Artificial sequence
  Synthetic oligonucleotide
taataaatttaaagtaaaac

SEQ ID NO: 1789 - DNA, 20 bp, Artificial sequence
  Synthetic oligonucleotide
gattataataaatttaaagt

SEQ ID NO: 1790 - DNA, 20 bp, Artificial sequence
  Synthetic oligonucleotide
ttgtgattataataaattta

SEQ ID NO: 1791 - DNA, 20 bp, Artificial sequence
  Synthetic oligonucleotide
tttgtgattataataaattt

SEQ ID NO: 1792 - DNA, 20 bp, Artificial sequence
  Synthetic oligonucleotide
attttgtgattataataaat

SEQ ID NO: 1793 - DNA, 20 bp, Artificial sequence
  Synthetic oligonucleotide
gaattttgtgattataataa

SEQ ID NO: 1794 - DNA, 20 bp, Artificial sequence
  Synthetic oligonucleotide
gtagaaatatcagacagcac

SEQ ID NO: 1795 - DNA, 20 bp, Artificial sequence
  Synthetic oligonucleotide
catagtagaaatatcagaca

SEQ ID NO: 1796 - DNA, 20 bp, Artificial sequence
  Synthetic oligonucleotide
aacatagtagaaatatcaga

SEQ ID NO: 1797 - DNA, 20 bp, Artificial sequence
  Synthetic oligonucleotide
actaagaaaacatagtagaa

SEQ ID NO: 1798 - DNA, 20 bp, Artificial sequence
  Synthetic oligonucleotide
ttttttataaacaccttgga

SEQ ID NO: 1799 - DNA, 20 bp, Artificial sequence
  Synthetic oligonucleotide
gtgaaattagtcaccttgga

SEQ ID NO: 1800 - DNA, 20 bp, Artificial sequence
  Synthetic oligonucleotide
aagctgtgaaattagtcacc

SEQ ID NO: 1801 - DNA, 20 bp, Artificial sequence
  Synthetic oligonucleotide
ataagctgtgaaattagtca

SEQ ID NO: 1802 - DNA, 20 bp, Artificial sequence
  Synthetic oligonucleotide
ttaaaggtttaaagacataa

SEQ ID NO: 1803 - DNA, 20 bp, Artificial sequence
  Synthetic oligonucleotide
aacataattttaattgcttc

SEQ ID NO: 1804 - DNA, 20 bp, Artificial sequence
  Synthetic oligonucleotide
agaacataattttaattgct

SEQ ID NO: 1805 - DNA, 20 bp, Artificial sequence
  Synthetic oligonucleotide
ataagcaaattgataaattt

SEQ ID NO: 1806 - DNA, 20 bp, Artificial sequence
  Synthetic oligonucleotide
caggtgaagatataagcaaa

SEQ ID NO: 1807 - DNA, 20 bp, Artificial sequence
  Synthetic oligonucleotide
cacaggtgaagatataagca

SEQ ID NO: 1808 - DNA, 20 bp, Artificial sequence
  Synthetic oligonucleotide
agcacaggtgaagatataag

SEQ ID NO: 1809 - DNA, 20 bp, Artificial sequence
  Synthetic oligonucleotide
cattcatctatttaaatagg

SEQ ID NO: 1810 - DNA, 20 bp, Artificial sequence
  Synthetic oligonucleotide
gaactgattatataagagag

SEQ ID NO: 1811 - DNA, 20 bp, Artificial sequence
  Synthetic oligonucleotide
ggaatattacaaaaaaaggg

SEQ ID NO: 1812 - DNA, 20 bp, Artificial sequence
  Synthetic oligonucleotide
agagacaatcctaaggaaaa

SEQ ID NO: 1813 - DNA, 20 bp, Artificial sequence
  Synthetic oligonucleotide
tagagacaatcctaaggaaa

SEQ ID NO: 1814 - DNA, 20 bp, Artificial sequence
  Synthetic oligonucleotide
cactagagacaatcctaagg

SEQ ID NO: 1815 - DNA, 20 bp, Artificial sequence
  Synthetic oligonucleotide
atggagaaaccccttccatc

SEQ ID NO: 1816 - DNA, 20 bp, Artificial sequence
  Synthetic oligonucleotide
ataccattactaaaagatgg

SEQ ID NO: 1817 - DNA, 20 bp, Artificial sequence
  Synthetic oligonucleotide
tccaaataccattactaaaa

SEQ ID NO: 1818 - DNA, 20 bp, Artificial sequence
  Synthetic oligonucleotide
ctccaaataccattactaaa

SEQ ID NO: 1819 - DNA, 20 bp, Artificial sequence
  Synthetic oligonucleotide
gatctccaaataccattact

SEQ ID NO: 1820 - DNA, 20 bp, Artificial sequence
  Synthetic oligonucleotide
gccagcactcaaattgtgat

SEQ ID NO: 1821 - DNA, 20 bp, Artificial sequence
  Synthetic oligonucleotide
cataacaaacccagcagcaa

SEQ ID NO: 1822 - DNA, 20 bp, Artificial sequence
  Synthetic oligonucleotide
taactacataacaaacccag

SEQ ID NO: 1823 - DNA, 20 bp, Artificial sequence
  Synthetic oligonucleotide
caataactacataacaaacc

SEQ ID NO: 1824 - DNA, 20 bp, Artificial sequence
  Synthetic oligonucleotide
acaataactacataacaaac

SEQ ID NO: 1825 - DNA, 20 bp, Artificial sequence
  Synthetic oligonucleotide
tcacaataactacataacaa

SEQ ID NO: 1826 - DNA, 20 bp, Artificial sequence
  Synthetic oligonucleotide
ttcacaataactacataaca

SEQ ID NO: 1827 - DNA, 20 bp, Artificial sequence
  Synthetic oligonucleotide
attcacaataactacataac

SEQ ID NO: 1828 - DNA, 20 bp, Artificial sequence
  Synthetic oligonucleotide
gtgaattcacaataactaca

SEQ ID NO: 1829 - DNA, 20 bp, Artificial sequence
  Synthetic oligonucleotide
tgtgaattcacaataactac

SEQ ID NO: 1830 - DNA, 20 bp, Artificial sequence
  Synthetic oligonucleotide
atgtgaattcacaataacta

SEQ ID NO: 1831 - DNA, 20 bp, Artificial sequence
  Synthetic oligonucleotide
ctatattcctaaatgtgaat

SEQ ID NO: 1832 - DNA, 20 bp, Artificial sequence
  Synthetic oligonucleotide
aaaccctatattcctaaatg

SEQ ID NO: 1833 - DNA, 20 bp, Artificial sequence
  Synthetic oligonucleotide
aattaaaaaccctatattcc

SEQ ID NO: 1834 - DNA, 20 bp, Artificial sequence
  Synthetic oligonucleotide
gaattaaaaaccctatattc

SEQ ID NO: 1835 - DNA, 20 bp, Artificial sequence
  Synthetic oligonucleotide
atctaaaatcaaagaattaa

SEQ ID NO: 1836 - DNA, 20 bp, Artificial sequence
  Synthetic oligonucleotide
tatctaaaatcaaagaatta

SEQ ID NO: 1837 - DNA, 20 bp, Artificial sequence
  Synthetic oligonucleotide
agtatctaaaatcaaagaat

SEQ ID NO: 1838 - DNA, 20 bp, Artificial sequence
  Synthetic oligonucleotide
acaagtatctaaaatcaaag

SEQ ID NO: 1839 - DNA, 20 bp, Artificial sequence
  Synthetic oligonucleotide
tacaagtatctaaaatcaaa

SEQ ID NO: 1840 - DNA, 20 bp, Artificial sequence
  Synthetic oligonucleotide
aaaaagatacaagtatctaa

SEQ ID NO: 1841 - DNA, 20 bp, Artificial sequence
  Synthetic oligonucleotide
agaaaaaagatacaagtatc

SEQ ID NO: 1842 - DNA, 20 bp, Artificial sequence
  Synthetic oligonucleotide
aggttttaaatataaaagaa

SEQ ID NO: 1843 - DNA, 20 bp, Artificial sequence
  Synthetic oligonucleotide
ccaaggttttaaatataaaa

SEQ ID NO: 1844 - DNA, 20 bp, Artificial sequence
  Synthetic oligonucleotide
gctgaaggccaaaggtagac

SEQ ID NO: 1845 - DNA, 20 bp, Artificial sequence
  Synthetic oligonucleotide
taggaaaaccacagcatggt

SEQ ID NO: 1846 - DNA, 20 bp, Artificial sequence
  Synthetic oligonucleotide
ttaggaaaaccacagcatgg

SEQ ID NO: 1847 - DNA, 20 bp, Artificial sequence
  Synthetic oligonucleotide
gttaggaaaaccacagcatg

SEQ ID NO: 1848 - DNA, 20 bp, Artificial sequence
  Synthetic oligonucleotide
acagatgatatttaagatcc

SEQ ID NO: 1849 - DNA, 20 bp, Artificial sequence
  Synthetic oligonucleotide
atagatcttatttacagatg

SEQ ID NO: 1850 - DNA, 20 bp, Artificial sequence
  Synthetic oligonucleotide
caagactaaagataaaagtt

SEQ ID NO: 1851 - DNA, 20 bp, Artificial sequence
  Synthetic oligonucleotide
tgtcaagactaaagataaaa

SEQ ID NO: 1852 - DNA, 20 bp, Artificial sequence
  Synthetic oligonucleotide
gatgtcaagactaaagataa

SEQ ID NO: 1853 - DNA, 20 bp, Artificial sequence
  Synthetic oligonucleotide
ggagttagtcaaagctaggt

SEQ ID NO: 1854 - DNA, 20 bp, Artificial sequence
  Synthetic oligonucleotide
taggagttagtcaaagctag

SEQ ID NO: 1855 - DNA, 20 bp, Artificial sequence
  Synthetic oligonucleotide
tggagatgccaaagctagga

SEQ ID NO: 1856 - DNA, 20 bp, Artificial sequence
  Synthetic oligonucleotide
tctttcatagacatgttcag

SEQ ID NO: 1857 - DNA, 20 bp, Artificial sequence
  Synthetic oligonucleotide
ataagtctttcatagacatg

SEQ ID NO: 1858 - DNA, 20 bp, Artificial sequence
  Synthetic oligonucleotide
aatggaaaacctgatggata

SEQ ID NO: 1859 - DNA, 20 bp, Artificial sequence
  Synthetic oligonucleotide
aagagtcacccttatggaaa

SEQ ID NO: 1860 - DNA, 20 bp, Artificial sequence
  Synthetic oligonucleotide
cggtataatatataggaacc

SEQ ID NO: 1861 - DNA, 20 bp, Artificial sequence
  Synthetic oligonucleotide
gtcggtataatatataggaa

SEQ ID NO: 1862 - DNA, 20 bp, Artificial sequence
  Synthetic oligonucleotide
ggttttattcaagacttcac

SEQ ID NO: 1863 - DNA, 20 bp, Artificial sequence
  Synthetic oligonucleotide
cttgggttttattcaagact

SEQ ID NO: 1864 - DNA, 20 bp, Artificial sequence
  Synthetic oligonucleotide
accatggtattctatgaaga

SEQ ID NO: 1865 - DNA, 20 bp, Artificial sequence
  Synthetic oligonucleotide
aataaatatgccagctcacc

SEQ ID NO: 1866 - DNA, 20 bp, Artificial sequence
  Synthetic oligonucleotide
tgtataataaatatgccagc

SEQ ID NO: 1867 - DNA, 20 bp, Artificial sequence
  Synthetic oligonucleotide
ttgtataataaatatgccag

SEQ ID NO: 1868 - DNA, 20 bp, Artificial sequence
  Synthetic oligonucleotide
gccagtaaaattgtttctgt

SEQ ID NO: 1869 - DNA, 20 bp, Artificial sequence
  Synthetic oligonucleotide
tgaacattttttatgaggac

SEQ ID NO: 1870 - DNA, 20 bp, Artificial sequence
  Synthetic oligonucleotide
ttgaacattttttatgagga

SEQ ID NO: 1871 - DNA, 20 bp, Artificial sequence
  Synthetic oligonucleotide
aatggaaaacctcaaaatag

SEQ ID NO: 1872 - DNA, 20 bp, Artificial sequence
  Synthetic oligonucleotide
atctaactgatttaagtttc

SEQ ID NO: 1873 - DNA, 20 bp, Artificial sequence
  Synthetic oligonucleotide
tacctaaaacaatctaactg

SEQ ID NO: 1874 - DNA, 20 bp, Artificial sequence
  Synthetic oligonucleotide
gctatacctaaaacaatcta

SEQ ID NO: 1875 - DNA, 20 bp, Artificial sequence
  Synthetic oligonucleotide
ggctatacctaaaacaatct

SEQ ID NO: 1876 - DNA, 20 bp, Artificial sequence
  Synthetic oligonucleotide
gggctatacctaaaacaatc

SEQ ID NO: 1877 - DNA, 20 bp, Artificial sequence
  Synthetic oligonucleotide
atgggctatacctaaaacaa

SEQ ID NO: 1878 - DNA, 20 bp, Artificial sequence
  Synthetic oligonucleotide
cacacaaaaaccaaggatgg

SEQ ID NO: 1879 - DNA, 20 bp, Artificial sequence
  Synthetic oligonucleotide
ccagggtttccccaagctag

SEQ ID NO: 1880 - DNA, 20 bp, Artificial sequence
  Synthetic oligonucleotide
ccagaaatccagggtttccc

SEQ ID NO: 1881 - DNA, 20 bp, Artificial sequence
  Synthetic oligonucleotide
ttccagaaatccagggtttc

SEQ ID NO: 1882 - DNA, 20 bp, Artificial sequence
  Synthetic oligonucleotide
atgattccagaaatccaggg

SEQ ID NO: 1883 - DNA, 20 bp, Artificial sequence
  Synthetic oligonucleotide
atatgattccagaaatccag

SEQ ID NO: 1884 - DNA, 20 bp, Artificial sequence
  Synthetic oligonucleotide
gtctaaatatgattccagaa

SEQ ID NO: 1885 - DNA, 20 bp, Artificial sequence
  Synthetic oligonucleotide
attacattagtctagtgtga

SEQ ID NO: 1886 - DNA, 20 bp, Artificial sequence
  Synthetic oligonucleotide
aaagaattacattagtctag

SEQ ID NO: 1887 - DNA, 20 bp, Artificial sequence
  Synthetic oligonucleotide
aaaagaattacattagtcta

SEQ ID NO: 1888 - DNA, 20 bp, Artificial sequence
  Synthetic oligonucleotide
cccaaaagaattacattagt

SEQ ID NO: 1889 - DNA, 20 bp, Artificial sequence
  Synthetic oligonucleotide
tcccaaaagaattacattag

SEQ ID NO: 1890 - DNA, 20 bp, Artificial sequence
  Synthetic oligonucleotide
atcccaaaagaattacatta

SEQ ID NO: 1891 - DNA, 20 bp, Artificial sequence
  Synthetic oligonucleotide
tttgcatcccaaaagaatta

SEQ ID NO: 1892 - DNA, 20 bp, Artificial sequence
  Synthetic oligonucleotide
aaaagctatttaaggtgtca

SEQ ID NO: 1893 - DNA, 20 bp, Artificial sequence
  Synthetic oligonucleotide
taaaagctatttaaggtgtc

SEQ ID NO: 1894 - DNA, 20 bp, Artificial sequence
  Synthetic oligonucleotide
ctaaaagctatttaaggtgt

SEQ ID NO: 1895 - DNA, 20 bp, Artificial sequence
  Synthetic oligonucleotide
ccaaatacctaaaagctatt

SEQ ID NO: 1896 - DNA, 20 bp, Artificial sequence
  Synthetic oligonucleotide
gccaaatacctaaaagctat

SEQ ID NO: 1897 - DNA, 20 bp, Artificial sequence
  Synthetic oligonucleotide
agccaaatacctaaaagcta

SEQ ID NO: 1898 - DNA, 20 bp, Artificial sequence
  Synthetic oligonucleotide
aagccaaatacctaaaagct

SEQ ID NO: 1899 - DNA, 20 bp, Artificial sequence
  Synthetic oligonucleotide
gaagccaaatacctaaaagc

SEQ ID NO: 1900 - DNA, 20 bp, Artificial sequence
  Synthetic oligonucleotide
ggaagccaaatacctaaaag

SEQ ID NO: 1901 - DNA, 20 bp, Artificial sequence
  Synthetic oligonucleotide
accccttgtaactaaaaata

SEQ ID NO: 1902 - DNA, 20 bp, Artificial sequence
  Synthetic oligonucleotide
tggctaaaactaatcatctg

SEQ ID NO: 1903 - DNA, 20 bp, Artificial sequence
  Synthetic oligonucleotide
atggctaaaactaatcatct

SEQ ID NO: 1904 - DNA, 20 bp, Artificial sequence
  Synthetic oligonucleotide
catggctaaaactaatcatc

SEQ ID NO: 1905 - DNA, 20 bp, Artificial sequence
  Synthetic oligonucleotide
cattacccttcatatataca

SEQ ID NO: 1906 - DNA, 20 bp, Artificial sequence
  Synthetic oligonucleotide
tccttaatacattacccttc

SEQ ID NO: 1907 - DNA, 20 bp, Artificial sequence
  Synthetic oligonucleotide
gtcgatactccttaatacat

SEQ ID NO: 1908 - DNA, 20 bp, Artificial sequence
  Synthetic oligonucleotide
ctacaaattattgtttctgg

SEQ ID NO: 1909 - DNA, 20 bp, Artificial sequence
  Synthetic oligonucleotide
ggctacaaattattgtttct

SEQ ID NO: 1910 - DNA, 20 bp, Artificial sequence
  Synthetic oligonucleotide
aggctacaaattattgtttc

SEQ ID NO: 1911 - DNA, 20 bp, Artificial sequence
  Synthetic oligonucleotide
aaggctacaaattattgttt

SEQ ID NO: 1912 - DNA, 20 bp, Artificial sequence
  Synthetic oligonucleotide
tgaaggctacaaattattgt

SEQ ID NO: 1913 - DNA, 20 bp, Artificial sequence
  Synthetic oligonucleotide
actgttaaacatatgatact

SEQ ID NO: 1914 - DNA, 20 bp, Artificial sequence
  Synthetic oligonucleotide
tcttggtttctactgttaaa

SEQ ID NO: 1915 - DNA, 20 bp, Artificial sequence
  Synthetic oligonucleotide
aaagggccctactaatatag

SEQ ID NO: 1916 - DNA, 20 bp, Artificial sequence
  Synthetic oligonucleotide
tgagaaataaatatgtctgt

SEQ ID NO: 1917 - DNA, 20 bp, Artificial sequence
  Synthetic oligonucleotide
cctcactttctccattgtaa

SEQ ID NO: 1918 - DNA, 20 bp, Artificial sequence
  Synthetic oligonucleotide
tcttatacttactagtaaag

SEQ ID NO: 1919 - DNA, 20 bp, Artificial sequence
  Synthetic oligonucleotide
gattcttatacttactagta

SEQ ID NO: 1920 - DNA, 20 bp, Artificial sequence
  Synthetic oligonucleotide
tgattcttatacttactagt

SEQ ID NO: 1921 - DNA, 20 bp, Artificial sequence
  Synthetic oligonucleotide
taatgattcttatacttact

SEQ ID NO: 1922 - DNA, 20 bp, Artificial sequence
  Synthetic oligonucleotide
ataatgattcttatacttac

SEQ ID NO: 1923 - DNA, 20 bp, Artificial sequence
  Synthetic oligonucleotide
tagtccaaataatgattctt

SEQ ID NO: 1924 - DNA, 20 bp, Artificial sequence
  Synthetic oligonucleotide
tggaaaaaaatacaagctga

SEQ ID NO: 1925 - DNA, 20 bp, Artificial sequence
  Synthetic oligonucleotide
ctggaaaaaaatacaagctg

SEQ ID NO: 1926 - DNA, 20 bp, Artificial sequence
  Synthetic oligonucleotide
actggaaaaaaatacaagct

SEQ ID NO: 1927 - DNA, 20 bp, Artificial sequence
  Synthetic oligonucleotide
cactggaaaaaaatacaagc

SEQ ID NO: 1928 - DNA, 20 bp, Artificial sequence
  Synthetic oligonucleotide
gattcaaaattgatgtaaaa

SEQ ID NO: 1929 - DNA, 20 bp, Artificial sequence
  Synthetic oligonucleotide
agattcaaaattgatgtaaa

SEQ ID NO: 1930 - DNA, 20 bp, Artificial sequence
  Synthetic oligonucleotide
aagagattcaaaattgatgt

SEQ ID NO: 1931 - DNA, 20 bp, Artificial sequence
  Synthetic oligonucleotide
aaagagattcaaaattgatg

SEQ ID NO: 1932 - DNA, 20 bp, Artificial sequence
  Synthetic oligonucleotide
aaaatcaacctaaccagtta

SEQ ID NO: 1933 - DNA, 20 bp, Artificial sequence
  Synthetic oligonucleotide
aaaaatcaacctaaccagtt

SEQ ID NO: 1934 - DNA, 20 bp, Artificial sequence
  Synthetic oligonucleotide
aaaggcaaaaatcaacctaa

SEQ ID NO: 1935 - DNA, 20 bp, Artificial sequence
  Synthetic oligonucleotide
atagaataacctaaaaaaaa

SEQ ID NO: 1936 - DNA, 20 bp, Artificial sequence
  Synthetic oligonucleotide
tatagaataacctaaaaaaa

SEQ ID NO: 1937 - DNA, 20 bp, Artificial sequence
  Synthetic oligonucleotide
aaatatagaataacctaaaa

SEQ ID NO: 1938 - DNA, 20 bp, Artificial sequence
  Synthetic oligonucleotide
acaaatatagaataacctaa

SEQ ID NO: 1939 - DNA, 20 bp, Artificial sequence
  Synthetic oligonucleotide
ggcctcatttttacctttgc

SEQ ID NO: 1940 - DNA, 20 bp, Artificial sequence
  Synthetic oligonucleotide
gaaatactaccatatattcc

SEQ ID NO: 1941 - DNA, 20 bp, Artificial sequence
  Synthetic oligonucleotide
agcatgaaaatttaattctc

SEQ ID NO: 1942 - DNA, 20 bp, Artificial sequence
  Synthetic oligonucleotide
ttcactaaaatataaggtcc

SEQ ID NO: 1943 - DNA, 20 bp, Artificial sequence
  Synthetic oligonucleotide
ctaataaacttcactaaaat

SEQ ID NO: 1944 - DNA, 20 bp, Artificial sequence
  Synthetic oligonucleotide
actaataaacttcactaaaa

SEQ ID NO: 1945 - DNA, 20 bp, Artificial sequence
  Synthetic oligonucleotide
attcaagtttaaactaataa

SEQ ID NO: 1946 - DNA, 20 bp, Artificial sequence
  Synthetic oligonucleotide
taagtatttcaaagagttga

SEQ ID NO: 1947 - DNA, 20 bp, Artificial sequence
  Synthetic oligonucleotide
tttaagtatttcaaagagtt

SEQ ID NO: 1948 - DNA, 20 bp, Artificial sequence
  Synthetic oligonucleotide
taatatatttaagtatttca

SEQ ID NO: 1949 - DNA, 20 bp, Artificial sequence
  Synthetic oligonucleotide
actaagttaatatatttaag

SEQ ID NO: 1950 - DNA, 20 bp, Artificial sequence
  Synthetic oligonucleotide
aggaatataccataccagct

SEQ ID NO: 1951 - DNA, 20 bp, Artificial sequence
  Synthetic oligonucleotide
ctaggaatataccataccag

SEQ ID NO: 1952 - DNA, 20 bp, Artificial sequence
  Synthetic oligonucleotide
ctagtaatataatgattgtg

SEQ ID NO: 1953 - DNA, 20 bp, Artificial sequence
  Synthetic oligonucleotide
gctctagtaatataatgatt

SEQ ID NO: 1954 - DNA, 20 bp, Artificial sequence
  Synthetic oligonucleotide
ttctggcaaataagctctag

SEQ ID NO: 1955 - DNA, 20 bp, Artificial sequence
  Synthetic oligonucleotide
ttagacataacataaaggca

SEQ ID NO: 1956 - DNA, 20 bp, Artificial sequence
  Synthetic oligonucleotide
aatcttctattttagacata

SEQ ID NO: 1957 - DNA, 20 bp, Artificial sequence
  Synthetic oligonucleotide
caaccaatcttctattttag

SEQ ID NO: 1958 - DNA, 20 bp, Artificial sequence
  Synthetic oligonucleotide
gcaaccaatcttctatttta

SEQ ID NO: 1959 - DNA, 20 bp, Artificial sequence
  Synthetic oligonucleotide
taactgcaaccaatcttcta

SEQ ID NO: 1960 - DNA, 20 bp, Artificial sequence
  Synthetic oligonucleotide
actctaaagaacaaaagcac

SEQ ID NO: 1961 - DNA, 20 bp, Artificial sequence
  Synthetic oligonucleotide
tatggactctaaagaacaaa

SEQ ID NO: 1962 - DNA, 20 bp, Artificial sequence
  Synthetic oligonucleotide
gtctttaccttgcatactta

SEQ ID NO: 1963 - DNA, 20 bp, Artificial sequence
  Synthetic oligonucleotide
tcagaatgtctttaccttgc

SEQ ID NO: 1964 - DNA, 20 bp, Artificial sequence
  Synthetic oligonucleotide
tgaatacaacacacatcaga

SEQ ID NO: 1965 - DNA, 20 bp, Artificial sequence
  Synthetic oligonucleotide
cagcaatgaatacaacacac

SEQ ID NO: 1966 - DNA, 20 bp, Artificial sequence
  Synthetic oligonucleotide
ttcagcaatgaatacaacac

SEQ ID NO: 1967 - DNA, 20 bp, Artificial sequence
  Synthetic oligonucleotide
aatcaattcttcagcaatga

SEQ ID NO: 1968 - DNA, 20 bp, Artificial sequence
  Synthetic oligonucleotide
gaatcaattcttcagcaatg

SEQ ID NO: 1969 - DNA, 20 bp, Artificial sequence
  Synthetic oligonucleotide
gaaatctaagaataattgga

SEQ ID NO: 1970 - DNA, 20 bp, Artificial sequence
  Synthetic oligonucleotide
tacattaacttccatgaaat

SEQ ID NO: 1971 - DNA, 20 bp, Artificial sequence
  Synthetic oligonucleotide
ctaagagtacattaacttcc

SEQ ID NO: 1972 - DNA, 20 bp, Artificial sequence
  Synthetic oligonucleotide
aattgtcaaaacacctctaa

SEQ ID NO: 1973 - DNA, 20 bp, Artificial sequence
  Synthetic oligonucleotide
aaagggaaagcccactatat

SEQ ID NO: 1974 - DNA, 20 bp, Artificial sequence
  Synthetic oligonucleotide
agtgatttccattataagaa

SEQ ID NO: 1975 - DNA, 20 bp, Artificial sequence
  Synthetic oligonucleotide
aagtgatttccattataaga

SEQ ID NO: 1976 - DNA, 20 bp, Artificial sequence
  Synthetic oligonucleotide
cctaataaaatataggttgt

SEQ ID NO: 1977 - DNA, 20 bp, Artificial sequence
  Synthetic oligonucleotide
tcctaataaaatataggttg

SEQ ID NO: 1978 - DNA, 20 bp, Artificial sequence
  Synthetic oligonucleotide
ctcctaataaaatataggtt

SEQ ID NO: 1979 - DNA, 20 bp, Artificial sequence
  Synthetic oligonucleotide
actcctaataaaatataggt

SEQ ID NO: 1980 - DNA, 20 bp, Artificial sequence
  Synthetic oligonucleotide
tataactactcctaataaaa

SEQ ID NO: 1981 - DNA, 20 bp, Artificial sequence
  Synthetic oligonucleotide
aaatataactactcctaata

SEQ ID NO: 1982 - DNA, 20 bp, Artificial sequence
  Synthetic oligonucleotide
aaaaatataactactcctaa

SEQ ID NO: 1983 - DNA, 20 bp, Artificial sequence
  Synthetic oligonucleotide
aggagtaaaaatataactac

SEQ ID NO: 1984 - DNA, 20 bp, Artificial sequence
  Synthetic oligonucleotide
caggagtaaaaatataacta

SEQ ID NO: 1985 - DNA, 20 bp, Artificial sequence
  Synthetic oligonucleotide
ccaggagtaaaaatataact

SEQ ID NO: 1986 - DNA, 20 bp, Artificial sequence
  Synthetic oligonucleotide
taaaataaccaggagtaaaa

SEQ ID NO: 1987 - DNA, 20 bp, Artificial sequence
  Synthetic oligonucleotide
ccaaataaaataaccaggag

SEQ ID NO: 1988 - DNA, 20 bp, Artificial sequence
  Synthetic oligonucleotide
aaccaaataaaataaccagg

SEQ ID NO: 1989 - DNA, 20 bp, Artificial sequence
  Synthetic oligonucleotide
tgttgaaaccaaataaaata

SEQ ID NO: 1990 - DNA, 20 bp, Artificial sequence
  Synthetic oligonucleotide
ccacaatttactattgtgtt

SEQ ID NO: 1991 - DNA, 20 bp, Artificial sequence
  Synthetic oligonucleotide
aaaaccacaatttactattg

SEQ ID NO: 1992 - DNA, 20 bp, Artificial sequence
  Synthetic oligonucleotide
aagattaaaaccacaattta

SEQ ID NO: 1993 - DNA, 20 bp, Artificial sequence
  Synthetic oligonucleotide
actgatacccacaaagatta

SEQ ID NO: 1994 - DNA, 20 bp, Artificial sequence
  Synthetic oligonucleotide
aagggtcaactgatacccac

SEQ ID NO: 1995 - DNA, 20 bp, Artificial sequence
  Synthetic oligonucleotide
atggcacatatttatgtaac

SEQ ID NO: 1996 - DNA, 20 bp, Artificial sequence
  Synthetic oligonucleotide
agttgcatagccaataaatg

SEQ ID NO: 1997 - DNA, 20 bp, Artificial sequence
  Synthetic oligonucleotide
tatcactaaaaaactgggcc

SEQ ID NO: 1998 - DNA, 20 bp, Artificial sequence
  Synthetic oligonucleotide
atatcactaaaaaactgggc

SEQ ID NO: 1999 - DNA, 20 bp, Artificial sequence
  Synthetic oligonucleotide
tatatcactaaaaaactggg

SEQ ID NO: 2000 - DNA, 20 bp, Artificial sequence
  Synthetic oligonucleotide
ttatatcactaaaaaactgg

SEQ ID NO: 2001 - DNA, 20 bp, Artificial sequence
  Synthetic oligonucleotide
gtttatatcactaaaaaact

SEQ ID NO: 2002 - DNA, 20 bp, Artificial sequence
  Synthetic oligonucleotide
agtttatatcactaaaaaac

SEQ ID NO: 2003 - DNA, 20 bp, Artificial sequence
  Synthetic oligonucleotide
tagtttatatcactaaaaaa

SEQ ID NO: 2004 - DNA, 20 bp, Artificial sequence
  Synthetic oligonucleotide
atagtttatatcactaaaaa

SEQ ID NO: 2005 - DNA, 20 bp, Artificial sequence
  Synthetic oligonucleotide
tgatagtttatatcactaaa

SEQ ID NO: 2006 - DNA, 20 bp, Artificial sequence
  Synthetic oligonucleotide
attgatagtttatatcacta

SEQ ID NO: 2007 - DNA, 20 bp, Artificial sequence
  Synthetic oligonucleotide
tgtcttaacatttttctttg

SEQ ID NO: 2008 - DNA, 20 bp, Artificial sequence
  Synthetic oligonucleotide
cacttcaaacttttaattaa

SEQ ID NO: 2009 - DNA, 20 bp, Artificial sequence
  Synthetic oligonucleotide
ccacttcaaacttttaatta

SEQ ID NO: 2010 - DNA, 20 bp, Artificial sequence
  Synthetic oligonucleotide
aacccacttcaaacttttaa

SEQ ID NO: 2011 - DNA, 20 bp, Artificial sequence
  Synthetic oligonucleotide
aaaacccacttcaaactttt

SEQ ID NO: 2012 - DNA, 20 bp, Artificial sequence
  Synthetic oligonucleotide
aagcaaatacatatgagtta

SEQ ID NO: 2013 - DNA, 20 bp, Artificial sequence
  Synthetic oligonucleotide
agaagcaaatacatatgagt

SEQ ID NO: 2014 - DNA, 20 bp, Artificial sequence
  Synthetic oligonucleotide
tagaagcaaatacatatgag

SEQ ID NO: 2015 - DNA, 20 bp, Artificial sequence
  Synthetic oligonucleotide
atttcattagaaagtagaag

SEQ ID NO: 2016 - DNA, 20 bp, Artificial sequence
  Synthetic oligonucleotide
aaataatttcattagaaagt

SEQ ID NO: 2017 - DNA, 20 bp, Artificial sequence
  Synthetic oligonucleotide
tgataaataatttcattaga

SEQ ID NO: 2018 - DNA, 20 bp, Artificial sequence
  Synthetic oligonucleotide
ttaatgaaatttcaatttta

SEQ ID NO: 2019 - DNA, 20 bp, Artificial sequence
  Synthetic oligonucleotide
taatcttcccattaatgaaa

SEQ ID NO: 2020 - DNA, 20 bp, Artificial sequence
  Synthetic oligonucleotide
aaaataatcttcccattaat

SEQ ID NO: 2021 - DNA, 20 bp, Artificial sequence
  Synthetic oligonucleotide
ggataaaaataatcttccca

SEQ ID NO: 2022 - DNA, 20 bp, Artificial sequence
  Synthetic oligonucleotide
aggataaaaataatcttccc

SEQ ID NO: 2023 - DNA, 20 bp, Artificial sequence
  Synthetic oligonucleotide
agaggcaagaaaagttcagg

SEQ ID NO: 2024 - DNA, 20 bp, Artificial sequence
  Synthetic oligonucleotide
gattgcacaccatatggagt

SEQ ID NO: 2025 - DNA, 20 bp, Artificial sequence
  Synthetic oligonucleotide
ctattaatcaaaaatgggat

SEQ ID NO: 2026 - DNA, 20 bp, Artificial sequence
  Synthetic oligonucleotide
tctattaatcaaaaatggga

SEQ ID NO: 2027 - DNA, 20 bp, Artificial sequence
  Synthetic oligonucleotide
actctattaatcaaaaatgg

SEQ ID NO: 2028 - DNA, 20 bp, Artificial sequence
  Synthetic oligonucleotide
aggactctattaatcaaaaa

SEQ ID NO: 2029 - DNA, 20 bp, Artificial sequence
  Synthetic oligonucleotide
gcaggactctattaatcaaa

SEQ ID NO: 2030 - DNA, 20 bp, Artificial sequence
  Synthetic oligonucleotide
ccctgctaatccagcaggac

SEQ ID NO: 2031 - DNA, 20 bp, Artificial sequence
  Synthetic oligonucleotide
aaagaaatctaaagctgatt

SEQ ID NO: 2032 - DNA, 20 bp, Artificial sequence
  Synthetic oligonucleotide
agaatattctactcttctgg

SEQ ID NO: 2033 - DNA, 20 bp, Artificial sequence
  Synthetic oligonucleotide
ttaagaatattctactcttc

SEQ ID NO: 2034 - DNA, 20 bp, Artificial sequence
  Synthetic oligonucleotide
ctctttaagaatattctact

SEQ ID NO: 2035 - DNA, 20 bp, Artificial sequence
  Synthetic oligonucleotide
tctctttaagaatattctac

SEQ ID NO: 2036 - DNA, 20 bp, Artificial sequence
  Synthetic oligonucleotide
ttcaagcaacaatatgtttg

SEQ ID NO: 2037 - DNA, 20 bp, Artificial sequence
  Synthetic oligonucleotide
tttaccaattcaagcaacaa

SEQ ID NO: 2038 - DNA, 20 bp, Artificial sequence
  Synthetic oligonucleotide
atttaccaattcaagcaaca

SEQ ID NO: 2039 - DNA, 20 bp, Artificial sequence
  Synthetic oligonucleotide
gtatttaccaattcaagcaa

SEQ ID NO: 2040 - DNA, 20 bp, Artificial sequence
  Synthetic oligonucleotide
actgtatttaccaattcaag

SEQ ID NO: 2041 - DNA, 20 bp, Artificial sequence
  Synthetic oligonucleotide
aaaccaatcactgtatttac

SEQ ID NO: 2042 - DNA, 20 bp, Artificial sequence
  Synthetic oligonucleotide
acaacaaaaaccaatcactg

SEQ ID NO: 2043 - DNA, 20 bp, Artificial sequence
  Synthetic oligonucleotide
cacaacaaaaaccaatcact

SEQ ID NO: 2044 - DNA, 20 bp, Artificial sequence
  Synthetic oligonucleotide
acctgaaaacaaaacacaac

SEQ ID NO: 2045 - DNA, 20 bp, Artificial sequence
  Synthetic oligonucleotide
tacctgaaaacaaaacacaa

SEQ ID NO: 2046 - DNA, 20 bp, Artificial sequence
  Synthetic oligonucleotide
aactacctgaaaacaaaaca

SEQ ID NO: 2047 - DNA, 20 bp, Artificial sequence
  Synthetic oligonucleotide
tttacttttcaaagtaggct

SEQ ID NO: 2048 - DNA, 20 bp, Artificial sequence
  Synthetic oligonucleotide
ctttacttttcaaagtaggc

SEQ ID NO: 2049 - DNA, 20 bp, Artificial sequence
  Synthetic oligonucleotide
tactttacttttcaaagtag

SEQ ID NO: 2050 - DNA, 20 bp, Artificial sequence
  Synthetic oligonucleotide
aactactttacttttcaaag

SEQ ID NO: 2051 - DNA, 20 bp, Artificial sequence
  Synthetic oligonucleotide
taccaactactttacttttc

SEQ ID NO: 2052 - DNA, 20 bp, Artificial sequence
  Synthetic oligonucleotide
ttgtaccaactactttactt

SEQ ID NO: 2053 - DNA, 20 bp, Artificial sequence
  Synthetic oligonucleotide
aacatgctactttaacttgt

SEQ ID NO: 2054 - DNA, 20 bp, Artificial sequence
  Synthetic oligonucleotide
agcaaatattaaacatgcta

SEQ ID NO: 2055 - DNA, 20 bp, Artificial sequence
  Synthetic oligonucleotide
caaaatagccaaagcaaata

SEQ ID NO: 2056 - DNA, 20 bp, Artificial sequence
  Synthetic oligonucleotide
gacaaaatagccaaagcaaa

SEQ ID NO: 2057 - DNA, 20 bp, Artificial sequence
  Synthetic oligonucleotide
ttacaaatagacaaaatagc

SEQ ID NO: 2058 - DNA, 20 bp, Artificial sequence
  Synthetic oligonucleotide
aaccatttacaaatagacaa

SEQ ID NO: 2059 - DNA, 20 bp, Artificial sequence
  Synthetic oligonucleotide
gcagtaaccatttacaaata

SEQ ID NO: 2060 - DNA, 20 bp, Artificial sequence
  Synthetic oligonucleotide
attcaaatattcacaggatt

SEQ ID NO: 2061 - DNA, 20 bp, Artificial sequence
  Synthetic oligonucleotide
aaatacattcaaatattcac

SEQ ID NO: 2062 - DNA, 20 bp, Artificial sequence
  Synthetic oligonucleotide
gccgtaaatttttattttta

SEQ ID NO: 2063 - DNA, 20 bp, Artificial sequence
  Synthetic oligonucleotide
tgccgtaaatttttattttt

SEQ ID NO: 2064 - DNA, 20 bp, Artificial sequence
  Synthetic oligonucleotide
gtttaaaaaatttatccagt

SEQ ID NO: 2065 - DNA, 20 bp, Artificial sequence
  Synthetic oligonucleotide
agtttaaaaaatttatccag

SEQ ID NO: 2066 - DNA, 20 bp, Artificial sequence
  Synthetic oligonucleotide
cagtttaaaaaatttatcca

SEQ ID NO: 2067 - DNA, 20 bp, Artificial sequence
  Synthetic oligonucleotide
cactcagtttaaaaaattta

SEQ ID NO: 2068 - DNA, 20 bp, Artificial sequence
  Synthetic oligonucleotide
ataaggtttccttcactcag

SEQ ID NO: 2069 - DNA, 20 bp, Artificial sequence
  Synthetic oligonucleotide
taaatgaaattttataaggt

SEQ ID NO: 2070 - DNA, 20 bp, Artificial sequence
  Synthetic oligonucleotide
gtcctaatttcatttttctt

SEQ ID NO: 2071 - DNA, 20 bp, Artificial sequence
  Synthetic oligonucleotide
ttgtcctaatttcatttttc

SEQ ID NO: 2072 - DNA, 20 bp, Artificial sequence
  Synthetic oligonucleotide
agggttaatcaggtaagcaa

SEQ ID NO: 2073 - DNA, 20 bp, Artificial sequence
  Synthetic oligonucleotide
gcagggttaatcaggtaagc

SEQ ID NO: 2074 - DNA, 20 bp, Artificial sequence
  Synthetic oligonucleotide
ttgatccagatttatggttt

SEQ ID NO: 2075 - DNA, 20 bp, Artificial sequence
  Synthetic oligonucleotide
aggagttgatccagatttat

SEQ ID NO: 2076 - DNA, 20 bp, Artificial sequence
  Synthetic oligonucleotide
aatgtattttcatatggtgg

SEQ ID NO: 2077 - DNA, 20 bp, Artificial sequence
  Synthetic oligonucleotide
aatgatagttacttgaaaag

SEQ ID NO: 2078 - DNA, 20 bp, Artificial sequence
  Synthetic oligonucleotide
tcttgtaatctttaacatga

SEQ ID NO: 2079 - DNA, 20 bp, Artificial sequence
  Synthetic oligonucleotide
ctgattatttatcttgtaat

SEQ ID NO: 2080 - DNA, 20 bp, Artificial sequence
  Synthetic oligonucleotide
tctgattatttatcttgtaa

SEQ ID NO: 2081 - DNA, 20 bp, Artificial sequence
  Synthetic oligonucleotide
gtctgattatttatcttgta

SEQ ID NO: 2082 - DNA, 20 bp, Artificial sequence
  Synthetic oligonucleotide
ggtctgattatttatcttgt

SEQ ID NO: 2083 - DNA, 20 bp, Artificial sequence
  Synthetic oligonucleotide
tggatgaaatacagcaaata

SEQ ID NO: 2084 - DNA, 20 bp, Artificial sequence
  Synthetic oligonucleotide
agaatggatgaaatacagca

SEQ ID NO: 2085 - DNA, 20 bp, Artificial sequence
  Synthetic oligonucleotide
aatgtgaaactatgtgcatc

SEQ ID NO: 2086 - DNA, 20 bp, Artificial sequence
  Synthetic oligonucleotide
gaaatgtgaaactatgtgca

SEQ ID NO: 2087 - DNA, 20 bp, Artificial sequence
  Synthetic oligonucleotide
ttgaaatgtgaaactatgtg

SEQ ID NO: 2088 - DNA, 20 bp, Artificial sequence
  Synthetic oligonucleotide
ttctcaatttcagagacatt

SEQ ID NO: 2089 - DNA, 20 bp, Artificial sequence
  Synthetic oligonucleotide
cttctcaatttcagagacat

SEQ ID NO: 2090 - DNA, 20 bp, Artificial sequence
  Synthetic oligonucleotide
gcttctcaatttcagagaca

SEQ ID NO: 2091 - DNA, 20 bp, Artificial sequence
  Synthetic oligonucleotide
gtgctgctaatatactgtca

SEQ ID NO: 2092 - DNA, 20 bp, Artificial sequence
  Synthetic oligonucleotide
gagccaatatttataggtgc

SEQ ID NO: 2093 - DNA, 20 bp, Artificial sequence
  Synthetic oligonucleotide
tgagccaatatttataggtg

SEQ ID NO: 2094 - DNA, 20 bp, Artificial sequence
  Synthetic oligonucleotide
ttataccatcaaatgtaaaa

SEQ ID NO: 2095 - DNA, 20 bp, Artificial sequence
  Synthetic oligonucleotide
cattataccatcaaatgtaa

SEQ ID NO: 2096 - DNA, 20 bp, Artificial sequence
  Synthetic oligonucleotide
ttcattataccatcaaatgt

SEQ ID NO: 2097 - DNA, 20 bp, Artificial sequence
  Synthetic oligonucleotide
cttcattataccatcaaatg

SEQ ID NO: 2098 - DNA, 20 bp, Artificial sequence
  Synthetic oligonucleotide
tcttcattataccatcaaat

SEQ ID NO: 2099 - DNA, 20 bp, Artificial sequence
  Synthetic oligonucleotide
ggtaaatattttcttcatta

SEQ ID NO: 2100 - DNA, 20 bp, Artificial sequence
  Synthetic oligonucleotide
aaaaaggtaaatattttctt

SEQ ID NO: 2101 - DNA, 20 bp, Artificial sequence
  Synthetic oligonucleotide
gttgtgacttaaaaacaaaa

SEQ ID NO: 2102 - DNA, 20 bp, Artificial sequence
  Synthetic oligonucleotide
tgagttgtgacttaaaaaca

SEQ ID NO: 2103 - DNA, 20 bp, Artificial sequence
  Synthetic oligonucleotide
cagaattttccttcatctac

SEQ ID NO: 2104 - DNA, 20 bp, Artificial sequence
  Synthetic oligonucleotide
tcagaattttccttcatcta

SEQ ID NO: 2105 - DNA, 20 bp, Artificial sequence
  Synthetic oligonucleotide
atcagaattttccttcatct

SEQ ID NO: 2106 - DNA, 20 bp, Artificial sequence
  Synthetic oligonucleotide
atctcacattaagaggatgt

SEQ ID NO: 2107 - DNA, 20 bp, Artificial sequence
  Synthetic oligonucleotide
atatctcacattaagaggat

SEQ ID NO: 2108 - DNA, 20 bp, Artificial sequence
  Synthetic oligonucleotide
aatatctcacattaagagga

SEQ ID NO: 2109 - DNA, 20 bp, Artificial sequence
  Synthetic oligonucleotide
ctagaaatatctcacattaa

SEQ ID NO: 2110 - DNA, 20 bp, Artificial sequence
  Synthetic oligonucleotide
aaagactagaaatatctcac

SEQ ID NO: 2111 - DNA, 20 bp, Artificial sequence
  Synthetic oligonucleotide
taaagactagaaatatctca

SEQ ID NO: 2112 - DNA, 20 bp, Artificial sequence
  Synthetic oligonucleotide
atctatactgaataaagact

SEQ ID NO: 2113 - DNA, 20 bp, Artificial sequence
  Synthetic oligonucleotide
cattaatctatactgaataa

SEQ ID NO: 2114 - DNA, 20 bp, Artificial sequence
  Synthetic oligonucleotide
ccattaatctatactgaata

SEQ ID NO: 2115 - DNA, 20 bp, Artificial sequence
  Synthetic oligonucleotide
gccattaatctatactgaat

SEQ ID NO: 2116 - DNA, 20 bp, Artificial sequence
  Synthetic oligonucleotide
agccattaatctatactgaa

SEQ ID NO: 2117 - DNA, 20 bp, Artificial sequence
  Synthetic oligonucleotide
tagccattaatctatactga

SEQ ID NO: 2118 - DNA, 20 bp, Artificial sequence
  Synthetic oligonucleotide
ttagccattaatctatactg

SEQ ID NO: 2119 - DNA, 20 bp, Artificial sequence
  Synthetic oligonucleotide
attagccattaatctatact

SEQ ID NO: 2120 - DNA, 20 bp, Artificial sequence
  Synthetic oligonucleotide
taattagccattaatctata

SEQ ID NO: 2121 - DNA, 20 bp, Artificial sequence
  Synthetic oligonucleotide
ataattagccattaatctat

SEQ ID NO: 2122 - DNA, 20 bp, Artificial sequence
  Synthetic oligonucleotide
atataattagccattaatct

SEQ ID NO: 2123 - DNA, 20 bp, Artificial sequence
  Synthetic oligonucleotide
aaatttaacatataattagc

SEQ ID NO: 2124 - DNA, 20 bp, Artificial sequence
  Synthetic oligonucleotide
tactttgaaatttaacatat

SEQ ID NO: 2125 - DNA, 20 bp, Artificial sequence
  Synthetic oligonucleotide
aaaaagcactaataagcact

SEQ ID NO: 2126 - DNA, 20 bp, Artificial sequence
  Synthetic oligonucleotide
ttaaaagtaaaaagcactaa

SEQ ID NO: 2127 - DNA, 20 bp, Artificial sequence
  Synthetic oligonucleotide
aagttaattttgaaacttaa

SEQ ID NO: 2128 - DNA, 20 bp, Artificial sequence
  Synthetic oligonucleotide
tttggagtttattataataa

SEQ ID NO: 2129 - DNA, 20 bp, Artificial sequence
  Synthetic oligonucleotide
tgctagtttttctacttttg

SEQ ID NO: 2130 - DNA, 20 bp, Artificial sequence
  Synthetic oligonucleotide
atgggagtattataaaacga

SEQ ID NO: 2131 - DNA, 20 bp, Artificial sequence
  Synthetic oligonucleotide
cagtggaaagaatgggagat

SEQ ID NO: 2132 - DNA, 20 bp, Artificial sequence
  Synthetic oligonucleotide
aaaataatccaaacttgcag

SEQ ID NO: 2133 - DNA, 20 bp, Artificial sequence
  Synthetic oligonucleotide
tacaaaataatccaaacttg

SEQ ID NO: 2134 - DNA, 20 bp, Artificial sequence
  Synthetic oligonucleotide
gttacaaaataatccaaact

SEQ ID NO: 2135 - DNA, 20 bp, Artificial sequence
  Synthetic oligonucleotide
tgttacaaaataatccaaac

SEQ ID NO: 2136 - DNA, 20 bp, Artificial sequence
  Synthetic oligonucleotide
ttgttacaaaataatccaaa

SEQ ID NO: 2137 - DNA, 20 bp, Artificial sequence
  Synthetic oligonucleotide
tatagaataatatgatgatt

SEQ ID NO: 2138 - DNA, 20 bp, Artificial sequence
  Synthetic oligonucleotide
gacacatattaaaatggtta

SEQ ID NO: 2139 - DNA, 20 bp, Artificial sequence
  Synthetic oligonucleotide
gcatttaactatgttaaaaa

SEQ ID NO: 2140 - DNA, 20 bp, Artificial sequence
  Synthetic oligonucleotide
agcatttaactatgttaaaa

SEQ ID NO: 2141 - DNA, 20 bp, Artificial sequence
  Synthetic oligonucleotide
atagcatttaactatgttaa

SEQ ID NO: 2142 - DNA, 20 bp, Artificial sequence
  Synthetic oligonucleotide
attttatgacaatagcattt

SEQ ID NO: 2143 - DNA, 20 bp, Artificial sequence
  Synthetic oligonucleotide
tgatatagaattacaattaa

SEQ ID NO: 2144 - DNA, 20 bp, Artificial sequence
  Synthetic oligonucleotide
aagtagatttaagttatttt

SEQ ID NO: 2145 - DNA, 20 bp, Artificial sequence
  Synthetic oligonucleotide
attaagtagatttaagttat

SEQ ID NO: 2146 - DNA, 20 bp, Artificial sequence
  Synthetic oligonucleotide
ttttctaattaagtagattt

SEQ ID NO: 2147 - DNA, 20 bp, Artificial sequence
  Synthetic oligonucleotide
gtttttctaattaagtagat

SEQ ID NO: 2148 - DNA, 20 bp, Artificial sequence
  Synthetic oligonucleotide
agtttttctaattaagtaga

SEQ ID NO: 2149 - DNA, 20 bp, Artificial sequence
  Synthetic oligonucleotide
ttagtttttctaattaagta

SEQ ID NO: 2150 - DNA, 20 bp, Artificial sequence
  Synthetic oligonucleotide
tgttagtttttctaattaag

SEQ ID NO: 2151 - DNA, 20 bp, Artificial sequence
  Synthetic oligonucleotide
tgctttaatttctatatttc

SEQ ID NO: 2152 - DNA, 20 bp, Artificial sequence
  Synthetic oligonucleotide
gccaaaatactaacatcagt

SEQ ID NO: 2153 - DNA, 20 bp, Artificial sequence
  Synthetic oligonucleotide
tgccaaaatactaacatcag

SEQ ID NO: 2154 - DNA, 20 bp, Artificial sequence
  Synthetic oligonucleotide
gtgccaaaatactaacatca

SEQ ID NO: 2155 - DNA, 20 bp, Artificial sequence
  Synthetic oligonucleotide
tgtgccaaaatactaacatc

SEQ ID NO: 2156 - DNA, 20 bp, Artificial sequence
  Synthetic oligonucleotide
atgtgccaaaatactaacat

SEQ ID NO: 2157 - DNA, 20 bp, Artificial sequence
  Synthetic oligonucleotide
gaatgtgccaaaatactaac

SEQ ID NO: 2158 - DNA, 20 bp, Artificial sequence
  Synthetic oligonucleotide
agaatgtgccaaaatactaa

SEQ ID NO: 2159 - DNA, 20 bp, Artificial sequence
  Synthetic oligonucleotide
acagaaaaagaatgtgccaa

SEQ ID NO: 2160 - DNA, 20 bp, Artificial sequence
  Synthetic oligonucleotide
gagtacaacacttacaaggt

SEQ ID NO: 2161 - DNA, 20 bp, Artificial sequence
  Synthetic oligonucleotide
agactatttactgtcatagg

SEQ ID NO: 2162 - DNA, 20 bp, Artificial sequence
  Synthetic oligonucleotide
aaagactatttactgtcata

SEQ ID NO: 2163 - DNA, 20 bp, Artificial sequence
  Synthetic oligonucleotide
acaaagactatttactgtca

SEQ ID NO: 2164 - DNA, 20 bp, Artificial sequence
  Synthetic oligonucleotide
agcctgttacaaagactatt

SEQ ID NO: 2165 - DNA, 20 bp, Artificial sequence
  Synthetic oligonucleotide
tatgaaatatcatgcagcct

SEQ ID NO: 2166 - DNA, 20 bp, Artificial sequence
  Synthetic oligonucleotide
ttatgaaatatcatgcagcc

SEQ ID NO: 2167 - DNA, 20 bp, Artificial sequence
  Synthetic oligonucleotide
cattcattttatgaaatatc

SEQ ID NO: 2168 - DNA, 20 bp, Artificial sequence
  Synthetic oligonucleotide
acatataaattatgccacat

SEQ ID NO: 2169 - DNA, 20 bp, Artificial sequence
  Synthetic oligonucleotide
agcagaattcaaaaggctca

SEQ ID NO: 2170 - DNA, 20 bp, Artificial sequence
  Synthetic oligonucleotide
gcaatataagaattgttcat

SEQ ID NO: 2171 - DNA, 20 bp, Artificial sequence
  Synthetic oligonucleotide
tcctttaacccaataatctg

SEQ ID NO: 2172 - DNA, 20 bp, Artificial sequence
  Synthetic oligonucleotide
gttcatatcctttaacccaa

SEQ ID NO: 2173 - DNA, 20 bp, Artificial sequence
  Synthetic oligonucleotide
agcaatttagaaatctgttc

SEQ ID NO: 2174 - DNA, 20 bp, Artificial sequence
  Synthetic oligonucleotide
atgggaattattctggaaag

SEQ ID NO: 2175 - DNA, 20 bp, Artificial sequence
  Synthetic oligonucleotide
tgaaagtatcacatgggaat

SEQ ID NO: 2176 - DNA, 20 bp, Artificial sequence
  Synthetic oligonucleotide
aaacatggtgaaagtatcac

SEQ ID NO: 2177 - DNA, 20 bp, Artificial sequence
  Synthetic oligonucleotide
gatgtatgtctttagaccat

SEQ ID NO: 2178 - DNA, 20 bp, Artificial sequence
  Synthetic oligonucleotide
gcagtttatttttatgcttt

SEQ ID NO: 2179 - DNA, 20 bp, Artificial sequence
  Synthetic oligonucleotide
gtttcatatttttaatccag

SEQ ID NO: 2180 - DNA, 20 bp, Artificial sequence
  Synthetic oligonucleotide
tggaagtttcatatttttaa

SEQ ID NO: 2181 - DNA, 20 bp, Artificial sequence
  Synthetic oligonucleotide
ttggaagtttcatattttta

SEQ ID NO: 2182 - DNA, 20 bp, Artificial sequence
  Synthetic oligonucleotide
acttacttagtcattattgg

SEQ ID NO: 2183 - DNA, 20 bp, Artificial sequence
  Synthetic oligonucleotide
ttataacttacttagtcatt

SEQ ID NO: 2184 - DNA, 20 bp, Artificial sequence
  Synthetic oligonucleotide
tgttataacttacttagtca

SEQ ID NO: 2185 - DNA, 20 bp, Artificial sequence
  Synthetic oligonucleotide
cttgttataacttacttagt

SEQ ID NO: 2186 - DNA, 20 bp, Artificial sequence
  Synthetic oligonucleotide
tgtttactaaaaagcactag

SEQ ID NO: 2187 - DNA, 20 bp, Artificial sequence
  Synthetic oligonucleotide
ctgtttactaaaaagcacta

SEQ ID NO: 2188 - DNA, 20 bp, Artificial sequence
  Synthetic oligonucleotide
cctgtttactaaaaagcact

SEQ ID NO: 2189 - DNA, 20 bp, Artificial sequence
  Synthetic oligonucleotide
accctgtttactaaaaagca

SEQ ID NO: 2190 - DNA, 20 bp, Artificial sequence
  Synthetic oligonucleotide
gaacatttttaaaagggtac

SEQ ID NO: 2191 - DNA, 20 bp, Artificial sequence
  Synthetic oligonucleotide
cgaacatttttaaaagggta

SEQ ID NO: 2192 - DNA, 20 bp, Artificial sequence
  Synthetic oligonucleotide
ttcgaacatttttaaaaggg

SEQ ID NO: 2193 - DNA, 20 bp, Artificial sequence
  Synthetic oligonucleotide
gaggtatatcgatattcgaa

SEQ ID NO: 2194 - DNA, 20 bp, Artificial sequence
  Synthetic oligonucleotide
atcctccaccaagtaggaag

SEQ ID NO: 2195 - DNA, 20 bp, Artificial sequence
  Synthetic oligonucleotide
ctcaatcaatcctccaccaa

SEQ ID NO: 2196 - DNA, 20 bp, Artificial sequence
  Synthetic oligonucleotide
gcacactttcctcctcaatc

SEQ ID NO: 2197 - DNA, 20 bp, Artificial sequence
  Synthetic oligonucleotide
gctggtaaccatcactgcac

SEQ ID NO: 2198 - DNA, 20 bp, Artificial sequence
  Synthetic oligonucleotide
agctggtaaccatcactgca

SEQ ID NO: 2199 - DNA, 20 bp, Artificial sequence
  Synthetic oligonucleotide
aagtcaagccaagaggctga

SEQ ID NO: 2200 - DNA, 20 bp, Artificial sequence
  Synthetic oligonucleotide
caaagtcaagccaagaggct

SEQ ID NO: 2201 - DNA, 20 bp, Artificial sequence
  Synthetic oligonucleotide
atttgcaaagtcaagccaag

SEQ ID NO: 2202 - DNA, 20 bp, Artificial sequence
  Synthetic oligonucleotide
aattctcaccagtatttgca

SEQ ID NO: 2203 - DNA, 20 bp, Artificial sequence
  Synthetic oligonucleotide
agctctttccaaattctcac

SEQ ID NO: 2204 - DNA, 20 bp, Artificial sequence
  Synthetic oligonucleotide
taagatattctcaagctctt

SEQ ID NO: 2205 - DNA, 20 bp, Artificial sequence
  Synthetic oligonucleotide
tgtaagatattctcaagctc

SEQ ID NO: 2206 - DNA, 20 bp, Artificial sequence
  Synthetic oligonucleotide
ctatgtaagatattctcaag

SEQ ID NO: 2207 - DNA, 20 bp, Artificial sequence
  Synthetic oligonucleotide
gactatgtaagatattctca

SEQ ID NO: 2208 - DNA, 20 bp, Artificial sequence
  Synthetic oligonucleotide
gcaacatgtgactatgtaag

SEQ ID NO: 2209 - DNA, 20 bp, Artificial sequence
  Synthetic oligonucleotide
tagttcttaactcttctcag

SEQ ID NO: 2210 - DNA, 20 bp, Artificial sequence
  Synthetic oligonucleotide
agttagttcttaactcttct

SEQ ID NO: 2211 - DNA, 20 bp, Artificial sequence
  Synthetic oligonucleotide
aatgaacatcaagaagttag

SEQ ID NO: 2212 - DNA, 20 bp, Artificial sequence
  Synthetic oligonucleotide
aattttagtgaaaggcaaat

SEQ ID NO: 2213 - DNA, 20 bp, Artificial sequence
  Synthetic oligonucleotide
aatcaggaattttagtgaaa

SEQ ID NO: 2214 - DNA, 20 bp, Artificial sequence
  Synthetic oligonucleotide
ctaagtaatcaggaatttta

SEQ ID NO: 2215 - DNA, 20 bp, Artificial sequence
  Synthetic oligonucleotide
aaagacagaacctagagaga

SEQ ID NO: 2216 - DNA, 20 bp, Artificial sequence
  Synthetic oligonucleotide
ccaagctcccaaagacagaa

SEQ ID NO: 2217 - DNA, 20 bp, Artificial sequence
  Synthetic oligonucleotide
gcttgataaccttagaccca

SEQ ID NO: 2218 - DNA, 20 bp, Artificial sequence
  Synthetic oligonucleotide
caaatactcaaaaagggaaa

SEQ ID NO: 2219 - DNA, 20 bp, Artificial sequence
  Synthetic oligonucleotide
tcaaatactcaaaaagggaa

SEQ ID NO: 2220 - DNA, 20 bp, Artificial sequence
  Synthetic oligonucleotide
cttcaaatactcaaaaaggg

SEQ ID NO: 2221 - DNA, 20 bp, Artificial sequence
  Synthetic oligonucleotide
gcttcaaatactcaaaaagg

SEQ ID NO: 2222 - DNA, 20 bp, Artificial sequence
  Synthetic oligonucleotide
agcttcaaatactcaaaaag

SEQ ID NO: 2223 - DNA, 20 bp, Artificial sequence
  Synthetic oligonucleotide
atgaagcttcaaatactcaa

SEQ ID NO: 2224 - DNA, 20 bp, Artificial sequence
  Synthetic oligonucleotide
tactatattcagtatgaagc

SEQ ID NO: 2225 - DNA, 20 bp, Artificial sequence
  Synthetic oligonucleotide
ttactatattcagtatgaag

SEQ ID NO: 2226 - DNA, 20 bp, Artificial sequence
  Synthetic oligonucleotide
gattactatattcagtatga

SEQ ID NO: 2227 - DNA, 20 bp, Artificial sequence
  Synthetic oligonucleotide
atgattactatattcagtat

SEQ ID NO: 2228 - DNA, 20 bp, Artificial sequence
  Synthetic oligonucleotide
ctatgattactatattcagt

SEQ ID NO: 2229 - DNA, 20 bp, Artificial sequence
  Synthetic oligonucleotide
actatgattactatattcag

SEQ ID NO: 2230 - DNA, 20 bp, Artificial sequence
  Synthetic oligonucleotide
tactatgattactatattca

SEQ ID NO: 2231 - DNA, 20 bp, Artificial sequence
  Synthetic oligonucleotide
gaatactatgattactatat

SEQ ID NO: 2232 - DNA, 20 bp, Artificial sequence
  Synthetic oligonucleotide
tgaatactatgattactata

SEQ ID NO: 2233 - DNA, 20 bp, Artificial sequence
  Synthetic oligonucleotide
gcatgaatactatgattact

SEQ ID NO: 2234 - DNA, 20 bp, Artificial sequence
  Synthetic oligonucleotide
tatgattttctttatgcatg

SEQ ID NO: 2235 - DNA, 20 bp, Artificial sequence
  Synthetic oligonucleotide
ttatgattttctttatgcat

SEQ ID NO: 2236 - DNA, 20 bp, Artificial sequence
  Synthetic oligonucleotide
gcaattactttatgattttc

SEQ ID NO: 2237 - DNA, 20 bp, Artificial sequence
  Synthetic oligonucleotide
atgcaattactttatgattt

SEQ ID NO: 2238 - DNA, 20 bp, Artificial sequence
  Synthetic oligonucleotide
tatgcaattactttatgatt

SEQ ID NO: 2239 - DNA, 20 bp, Artificial sequence
  Synthetic oligonucleotide
ttatgcaattactttatgat

SEQ ID NO: 2240 - DNA, 20 bp, Artificial sequence
  Synthetic oligonucleotide
tttatgcaattactttatga

SEQ ID NO: 2241 - DNA, 20 bp, Artificial sequence
  Synthetic oligonucleotide
atgattactttatgcattta

SEQ ID NO: 2242 - DNA, 20 bp, Artificial sequence
  Synthetic oligonucleotide
ctatgattactttatgcatt

SEQ ID NO: 2243 - DNA, 20 bp, Artificial sequence
  Synthetic oligonucleotide
gaaaactatgattactttat

SEQ ID NO: 2244 - DNA, 20 bp, Artificial sequence
  Synthetic oligonucleotide
tgaaaactatgattacttta

SEQ ID NO: 2245 - DNA, 20 bp, Artificial sequence
  Synthetic oligonucleotide
tgcatgaaaactatgattac

SEQ ID NO: 2246 - DNA, 20 bp, Artificial sequence
  Synthetic oligonucleotide
ctagtttttttaatgcatga

SEQ ID NO: 2247 - DNA, 20 bp, Artificial sequence
  Synthetic oligonucleotide
actagtttttttaatgcatg

SEQ ID NO: 2248 - DNA, 20 bp, Artificial sequence
  Synthetic oligonucleotide
aactagtttttttaatgcat

SEQ ID NO: 2249 - DNA, 20 bp, Artificial sequence
  Synthetic oligonucleotide
ataaattatgaatctgtaat

SEQ ID NO: 2250 - DNA, 20 bp, Artificial sequence
  Synthetic oligonucleotide
actcataaattatgaatctg

SEQ ID NO: 2251 - DNA, 20 bp, Artificial sequence
  Synthetic oligonucleotide
gactcataaattatgaatct

SEQ ID NO: 2252 - DNA, 20 bp, Artificial sequence
  Synthetic oligonucleotide
tgactcataaattatgaatc

SEQ ID NO: 2253 - DNA, 20 bp, Artificial sequence
  Synthetic oligonucleotide
ttaatgactcataaattatg

SEQ ID NO: 2254 - DNA, 20 bp, Artificial sequence
  Synthetic oligonucleotide
ggcttgaaaatattatttaa

SEQ ID NO: 2255 - DNA, 20 bp, Artificial sequence
  Synthetic oligonucleotide
gctggaaaaaatgtcatggc

SEQ ID NO: 2256 - DNA, 20 bp, Artificial sequence
  Synthetic oligonucleotide
tgctggaaaaaatgtcatgg

SEQ ID NO: 2257 - DNA, 20 bp, Artificial sequence
  Synthetic oligonucleotide
gtaaaacagatttagagact

SEQ ID NO: 2258 - DNA, 20 bp, Artificial sequence
  Synthetic oligonucleotide
tggtaaaacagatttagaga

SEQ ID NO: 2259 - DNA, 20 bp, Artificial sequence
  Synthetic oligonucleotide
ggttttacagtgacacagct

SEQ ID NO: 2260 - DNA, 20 bp, Artificial sequence
  Synthetic oligonucleotide
ttgcttaatttcatgcttct

SEQ ID NO: 2261 - DNA, 20 bp, Artificial sequence
  Synthetic oligonucleotide
aaatagtttcacacacattg

SEQ ID NO: 2262 - DNA, 20 bp, Artificial sequence
  Synthetic oligonucleotide
taaaatagtttcacacacat

SEQ ID NO: 2263 - DNA, 20 bp, Artificial sequence
  Synthetic oligonucleotide
tataaaatagtttcacacac

SEQ ID NO: 2264 - DNA, 20 bp, Artificial sequence
  Synthetic oligonucleotide
aactgccaacatgtatgtat

SEQ ID NO: 2265 - DNA, 20 bp, Artificial sequence
  Synthetic oligonucleotide
catttcaaagccacacctag

SEQ ID NO: 2266 - DNA, 20 bp, Artificial sequence
  Synthetic oligonucleotide
catccatttcaaagccacac

SEQ ID NO: 2267 - DNA, 20 bp, Artificial sequence
  Synthetic oligonucleotide
tgtccatgaagatatttgtg

SEQ ID NO: 2268 - DNA, 20 bp, Artificial sequence
  Synthetic oligonucleotide
atagcaatccatgtccatga

SEQ ID NO: 2269 - DNA, 20 bp, Artificial sequence
  Synthetic oligonucleotide
catagcaatccatgtccatg

SEQ ID NO: 2270 - DNA, 20 bp, Artificial sequence
  Synthetic oligonucleotide
tcatagcaatccatgtccat

SEQ ID NO: 2271 - DNA, 20 bp, Artificial sequence
  Synthetic oligonucleotide
ttaggcaatcaaacactcat

SEQ ID NO: 2272 - DNA, 20 bp, Artificial sequence
  Synthetic oligonucleotide
taaattataccatatcactg

SEQ ID NO: 2273 - DNA, 20 bp, Artificial sequence
  Synthetic oligonucleotide
tgataaattataccatatca

SEQ ID NO: 2274 - DNA, 20 bp, Artificial sequence
  Synthetic oligonucleotide
tgtttgataaattataccat

SEQ ID NO: 2275 - DNA, 20 bp, Artificial sequence
  Synthetic oligonucleotide
tttctgtttctcaacactgt

SEQ ID NO: 2276 - DNA, 20 bp, Artificial sequence
  Synthetic oligonucleotide
ctctttaaaacatccccagt

SEQ ID NO: 2277 - DNA, 20 bp, Artificial sequence
  Synthetic oligonucleotide
tttcctctttaaaacatccc

SEQ ID NO: 2278 - DNA, 20 bp, Artificial sequence
  Synthetic oligonucleotide
tatgtaaacccctaatttct

SEQ ID NO: 2279 - DNA, 20 bp, Artificial sequence
  Synthetic oligonucleotide
tttcttaagattatgtaaac

SEQ ID NO: 2280 - DNA, 20 bp, Artificial sequence
  Synthetic oligonucleotide
tttaatatcctcattaccca

SEQ ID NO: 2281 - DNA, 20 bp, Artificial sequence
  Synthetic oligonucleotide
atttaatatcctcattaccc

SEQ ID NO: 2282 - DNA, 20 bp, Artificial sequence
  Synthetic oligonucleotide
aatttaatatcctcattacc

SEQ ID NO: 2283 - DNA, 20 bp, Artificial sequence
  Synthetic oligonucleotide
cttaaatttaatatcctcat

SEQ ID NO: 2284 - DNA, 20 bp, Artificial sequence
  Synthetic oligonucleotide
ttcttaaatttaatatcctc

SEQ ID NO: 2285 - DNA, 20 bp, Artificial sequence
  Synthetic oligonucleotide
tgttcttaaatttaatatcc

SEQ ID NO: 2286 - DNA, 20 bp, Artificial sequence
  Synthetic oligonucleotide
gctttctatgccaaggatca

SEQ ID NO: 2287 - DNA, 20 bp, Artificial sequence
  Synthetic oligonucleotide
agtcccaaaattctgcttca

SEQ ID NO: 2288 - DNA, 20 bp, Artificial sequence
  Synthetic oligonucleotide
tgccagtcccaaaattctgc

SEQ ID NO: 2289 - DNA, 20 bp, Artificial sequence
  Synthetic oligonucleotide
gcaagcaaagccatttggga

SEQ ID NO: 2290 - DNA, 20 bp, Artificial sequence
  Synthetic oligonucleotide
ctaaaaatacaaaccttgtc

SEQ ID NO: 2291 - DNA, 20 bp, Artificial sequence
  Synthetic oligonucleotide
catgagctttaaaaagcaga

SEQ ID NO: 2292 - DNA, 20 bp, Artificial sequence
  Synthetic oligonucleotide
tggttacaaattaagtgctc

SEQ ID NO: 2293 - DNA, 20 bp, Artificial sequence
  Synthetic oligonucleotide
ctggttacaaattaagtgct

SEQ ID NO: 2294 - DNA, 20 bp, Artificial sequence
  Synthetic oligonucleotide
ttctggttacaaattaagtg

SEQ ID NO: 2295 - DNA, 20 bp, Artificial sequence
  Synthetic oligonucleotide
attattttacaagtaggatt

SEQ ID NO: 2296 - DNA, 20 bp, Artificial sequence
  Synthetic oligonucleotide
tagattattttacaagtagg

SEQ ID NO: 2297 - DNA, 20 bp, Artificial sequence
  Synthetic oligonucleotide
ttagattattttacaagtag

SEQ ID NO: 2298 - DNA, 20 bp, Artificial sequence
  Synthetic oligonucleotide
cttagattattttacaagta

SEQ ID NO: 2299 - DNA, 20 bp, Artificial sequence
  Synthetic oligonucleotide
catgtcttagattattttac

SEQ ID NO: 2300 - DNA, 20 bp, Artificial sequence
  Synthetic oligonucleotide
tagaggttacaaagctaaaa

SEQ ID NO: 2301 - DNA, 20 bp, Artificial sequence
  Synthetic oligonucleotide
ccatcaatattatagaggtt

SEQ ID NO: 2302 - DNA, 20 bp, Artificial sequence
  Synthetic oligonucleotide
tccagctgtgaagacactga

SEQ ID NO: 2303 - DNA, 20 bp, Artificial sequence
  Synthetic oligonucleotide
accttgaaacaatgtagaca

SEQ ID NO: 2304 - DNA, 20 bp, Artificial sequence
  Synthetic oligonucleotide
acttttagtttatgaaaaat

SEQ ID NO: 2305 - DNA, 20 bp, Artificial sequence
  Synthetic oligonucleotide
ctacttttagtttatgaaaa

SEQ ID NO: 2306 - DNA, 20 bp, Artificial sequence
  Synthetic oligonucleotide
ttattctacttttagtttat

SEQ ID NO: 2307 - DNA, 20 bp, Artificial sequence
  Synthetic oligonucleotide
cctttattctacttttagtt

SEQ ID NO: 2308 - DNA, 20 bp, Artificial sequence
  Synthetic oligonucleotide
gcctttattctacttttagt

SEQ ID NO: 2309 - DNA, 20 bp, Artificial sequence
  Synthetic oligonucleotide
atagcctttattctactttt

SEQ ID NO: 2310 - DNA, 20 bp, Artificial sequence
  Synthetic oligonucleotide
aggaatagcctttattctac

SEQ ID NO: 2311 - DNA, 20 bp, Artificial sequence
  Synthetic oligonucleotide
agaggaatagcctttattct

SEQ ID NO: 2312 - DNA, 20 bp, Artificial sequence
  Synthetic oligonucleotide
agatagcaattttagaggaa

SEQ ID NO: 2313 - DNA, 20 bp, Artificial sequence
  Synthetic oligonucleotide
cccattagcaaatcctgatg

SEQ ID NO: 2314 - DNA, 20 bp, Artificial sequence
  Synthetic oligonucleotide
agaaagttcaactaatgaga

SEQ ID NO: 2315 - DNA, 20 bp, Artificial sequence
  Synthetic oligonucleotide
ttttgtgttttaaaactgtg

SEQ ID NO: 2316 - DNA, 20 bp, Artificial sequence
  Synthetic oligonucleotide
tggcacattttttatagagt

SEQ ID NO: 2317 - DNA, 20 bp, Artificial sequence
  Synthetic oligonucleotide
caacaattattaatagaatg

SEQ ID NO: 2318 - DNA, 20 bp, Artificial sequence
  Synthetic oligonucleotide
gcaacaattattaatagaat

SEQ ID NO: 2319 - DNA, 20 bp, Artificial sequence
  Synthetic oligonucleotide
agcaacaattattaatagaa

SEQ ID NO: 2320 - DNA, 20 bp, Artificial sequence
  Synthetic oligonucleotide
cagcaacaattattaataga

SEQ ID NO: 2321 - DNA, 20 bp, Artificial sequence
  Synthetic oligonucleotide
accagcaacaattattaata

SEQ ID NO: 2322 - DNA, 20 bp, Artificial sequence
  Synthetic oligonucleotide
taccagcaacaattattaat

SEQ ID NO: 2323 - DNA, 20 bp, Artificial sequence
  Synthetic oligonucleotide
ttttaaattaccagcaacaa

SEQ ID NO: 2324 - DNA, 20 bp, Artificial sequence
  Synthetic oligonucleotide
atttttaaattaccagcaac

SEQ ID NO: 2325 - DNA, 20 bp, Artificial sequence
  Synthetic oligonucleotide
aaggatttttaaattaccag

SEQ ID NO: 2326 - DNA, 20 bp, Artificial sequence
  Synthetic oligonucleotide
aacaaggatttttaaattac

SEQ ID NO: 2327 - DNA, 20 bp, Artificial sequence
  Synthetic oligonucleotide
gctgacaatctcagtgagaa

SEQ ID NO: 2328 - DNA, 20 bp, Artificial sequence
  Synthetic oligonucleotide
aacagctgacaatctcagtg

SEQ ID NO: 2329 - DNA, 20 bp, Artificial sequence
  Synthetic oligonucleotide
aaacttacaaacagctgaca

SEQ ID NO: 2330 - DNA, 20 bp, Artificial sequence
  Synthetic oligonucleotide
caaaacttacaaacagctga

SEQ ID NO: 2331 - DNA, 20 bp, Artificial sequence
  Synthetic oligonucleotide
accaaaaaccaaaacttaca

SEQ ID NO: 2332 - DNA, 20 bp, Artificial sequence
  Synthetic oligonucleotide
aaccaaaaaccaaaacttac

SEQ ID NO: 2333 - DNA, 20 bp, Artificial sequence
  Synthetic oligonucleotide
ctaaaaaaccccaaatctaa

SEQ ID NO: 2334 - DNA, 20 bp, Artificial sequence
  Synthetic oligonucleotide
cctaaaaaaccccaaatcta

SEQ ID NO: 2335 - DNA, 20 bp, Artificial sequence
  Synthetic oligonucleotide
tcctaaaaaaccccaaatct

SEQ ID NO: 2336 - DNA, 20 bp, Artificial sequence
  Synthetic oligonucleotide
attcacaaatcctaaaaaac

SEQ ID NO: 2337 - DNA, 20 bp, Artificial sequence
  Synthetic oligonucleotide
gcaaatattcacaaatccta

SEQ ID NO: 2338 - DNA, 20 bp, Artificial sequence
  Synthetic oligonucleotide
gtgcaaatattcacaaatcc

SEQ ID NO: 2339 - DNA, 20 bp, Artificial sequence
  Synthetic oligonucleotide
agtgcaaatattcacaaatc

SEQ ID NO: 2340 - DNA, 20 bp, Artificial sequence
  Synthetic oligonucleotide
atagtgcaaatattcacaaa

SEQ ID NO: 2341 - DNA, 20 bp, Artificial sequence
  Synthetic oligonucleotide
catgatactcaaaagaggtg

SEQ ID NO: 2342 - DNA, 20 bp, Artificial sequence
  Synthetic oligonucleotide
catcctaaatccgagaatca

SEQ ID NO: 2343 - DNA, 20 bp, Artificial sequence
  Synthetic oligonucleotide
caagcatcctaaatccgaga

SEQ ID NO: 2344 - DNA, 20 bp, Artificial sequence
  Synthetic oligonucleotide
aatctgaaattacaggtcaa

SEQ ID NO: 2345 - DNA, 20 bp, Artificial sequence
  Synthetic oligonucleotide
taaatctgaaattacaggtc

SEQ ID NO: 2346 - DNA, 20 bp, Artificial sequence
  Synthetic oligonucleotide
ttctgcttttatgtaaatct

SEQ ID NO: 2347 - DNA, 20 bp, Artificial sequence
  Synthetic oligonucleotide
catattattcccaaatggtt

SEQ ID NO: 2348 - DNA, 20 bp, Artificial sequence
  Synthetic oligonucleotide
acttagaaaatatacactga

SEQ ID NO: 2349 - DNA, 20 bp, Artificial sequence
  Synthetic oligonucleotide
gtacttagaaaatatacact

SEQ ID NO: 2350 - DNA, 20 bp, Artificial sequence
  Synthetic oligonucleotide
taggaatatattcttgtact

SEQ ID NO: 2351 - DNA, 20 bp, Artificial sequence
  Synthetic oligonucleotide
tatgtaggaatatattcttg

SEQ ID NO: 2352 - DNA, 20 bp, Artificial sequence
  Synthetic oligonucleotide
taaaatgtttaaacatgacg

SEQ ID NO: 2353 - DNA, 20 bp, Artificial sequence
  Synthetic oligonucleotide
tccccattttaaaatgttta

SEQ ID NO: 2354 - DNA, 20 bp, Artificial sequence
  Synthetic oligonucleotide
taatacaaatccccatttta

SEQ ID NO: 2355 - DNA, 20 bp, Artificial sequence
  Synthetic oligonucleotide
aatgtaatacaaatccccat

SEQ ID NO: 2356 - DNA, 20 bp, Artificial sequence
  Synthetic oligonucleotide
atcagattttaagtaatact

SEQ ID NO: 2357 - DNA, 20 bp, Artificial sequence
  Synthetic oligonucleotide
attatcagattttaagtaat

SEQ ID NO: 2358 - DNA, 20 bp, Artificial sequence
  Synthetic oligonucleotide
cacattatcagattttaagt

SEQ ID NO: 2359 - DNA, 20 bp, Artificial sequence
  Synthetic oligonucleotide
acacattatcagattttaag

SEQ ID NO: 2360 - DNA, 20 bp, Artificial sequence
  Synthetic oligonucleotide
cacacattatcagattttaa

SEQ ID NO: 2361 - DNA, 20 bp, Artificial sequence
  Synthetic oligonucleotide
tttaacacacattatcagat

SEQ ID NO: 2362 - DNA, 20 bp, Artificial sequence
  Synthetic oligonucleotide
actatttaacacacattatc

SEQ ID NO: 2363 - DNA, 20 bp, Artificial sequence
  Synthetic oligonucleotide
ctactatttaacacacatta

SEQ ID NO: 2364 - DNA, 20 bp, Artificial sequence
  Synthetic oligonucleotide
aaactactatttaacacaca

SEQ ID NO: 2365 - DNA, 20 bp, Artificial sequence
  Synthetic oligonucleotide
aaaactactatttaacacac

SEQ ID NO: 2366 - DNA, 20 bp, Artificial sequence
  Synthetic oligonucleotide
aatgaaaactactatttaac

SEQ ID NO: 2367 - DNA, 20 bp, Artificial sequence
  Synthetic oligonucleotide
tatcttactcatctatttcc

SEQ ID NO: 2368 - DNA, 20 bp, Artificial sequence
  Synthetic oligonucleotide
tatttccctctttatggcat

SEQ ID NO: 2369 - DNA, 20 bp, Artificial sequence
  Synthetic oligonucleotide
cccattatttcatcacttca

SEQ ID NO: 2370 - DNA, 20 bp, Artificial sequence
  Synthetic oligonucleotide
tgacattcccattatttcat

SEQ ID NO: 2371 - DNA, 20 bp, Artificial sequence
  Synthetic oligonucleotide
ccatcccaccaaaagtagcc

SEQ ID NO: 2372 - DNA, 20 bp, Artificial sequence
  Synthetic oligonucleotide
agcttaaaatttatctcccc

SEQ ID NO: 2373 - DNA, 20 bp, Artificial sequence
  Synthetic oligonucleotide
gagcttaaaatttatctccc

SEQ ID NO: 2374 - DNA, 20 bp, Artificial sequence
  Synthetic oligonucleotide
ataatgtttccatggctggc

SEQ ID NO: 2375 - DNA, 20 bp, Artificial sequence
  Synthetic oligonucleotide
tgagttaacataatgtttcc

SEQ ID NO: 2376 - DNA, 20 bp, Artificial sequence
  Synthetic oligonucleotide
tgtgagttaacataatgttt

SEQ ID NO: 2377 - DNA, 20 bp, Artificial sequence
  Synthetic oligonucleotide
tcaaactaccatgtgagtta

SEQ ID NO: 2378 - DNA, 20 bp, Artificial sequence
  Synthetic oligonucleotide
catttcaaactaccatgtga

SEQ ID NO: 2379 - DNA, 20 bp, Artificial sequence
  Synthetic oligonucleotide
gcatttcaaactaccatgtg

SEQ ID NO: 2380 - DNA, 20 bp, Artificial sequence
  Synthetic oligonucleotide
aaagcatttcaaactaccat

SEQ ID NO: 2381 - DNA, 20 bp, Artificial sequence
  Synthetic oligonucleotide
agtcaccaaaaataagtacc

SEQ ID NO: 2382 - DNA, 20 bp, Artificial sequence
  Synthetic oligonucleotide
ttgttgaaagtcaccaaaaa

SEQ ID NO: 2383 - DNA, 20 bp, Artificial sequence
  Synthetic oligonucleotide
acccttaatattgttgaaag

SEQ ID NO: 2384 - DNA, 20 bp, Artificial sequence
  Synthetic oligonucleotide
agacccttaatattgttgaa

SEQ ID NO: 2385 - DNA, 20 bp, Artificial sequence
  Synthetic oligonucleotide
tttatagacccttaatattg

SEQ ID NO: 2386 - DNA, 20 bp, Artificial sequence
  Synthetic oligonucleotide
tacaaaaagattcactggta

SEQ ID NO: 2387 - DNA, 20 bp, Artificial sequence
  Synthetic oligonucleotide
catacaaaaagattcactgg

SEQ ID NO: 2388 - DNA, 20 bp, Artificial sequence
  Synthetic oligonucleotide
tatcatacaaaaagattcac

SEQ ID NO: 2389 - DNA, 20 bp, Artificial sequence
  Synthetic oligonucleotide
cctatcatacaaaaagattc

SEQ ID NO: 2390 - DNA, 20 bp, Artificial sequence
  Synthetic oligonucleotide
aaaacctatcatacaaaaag

SEQ ID NO: 2391 - DNA, 20 bp, Artificial sequence
  Synthetic oligonucleotide
aaacaaaaaacctatcatac

SEQ ID NO: 2392 - DNA, 20 bp, Artificial sequence
  Synthetic oligonucleotide
aataacctatcatggccagg

SEQ ID NO: 2393 - DNA, 20 bp, Artificial sequence
  Synthetic oligonucleotide
cacaaaataacctatcatgg

SEQ ID NO: 2394 - DNA, 20 bp, Artificial sequence
  Synthetic oligonucleotide
tcacaaaataacctatcatg

SEQ ID NO: 2395 - DNA, 20 bp, Artificial sequence
  Synthetic oligonucleotide
catcacaaaataacctatca

SEQ ID NO: 2396 - DNA, 20 bp, Artificial sequence
  Synthetic oligonucleotide
tcatcacaaaataacctatc

SEQ ID NO: 2397 - DNA, 20 bp, Artificial sequence
  Synthetic oligonucleotide
ttcatcacaaaataacctat

SEQ ID NO: 2398 - DNA, 20 bp, Artificial sequence
  Synthetic oligonucleotide
tttcatcacaaaataaccta

SEQ ID NO: 2399 - DNA, 20 bp, Artificial sequence
  Synthetic oligonucleotide
cagacaaattaagaggtagg

SEQ ID NO: 2400 - DNA, 20 bp, Artificial sequence
  Synthetic oligonucleotide
atcagacaaattaagaggta

SEQ ID NO: 2401 - DNA, 20 bp, Artificial sequence
  Synthetic oligonucleotide
tatcagacaaattaagaggt

SEQ ID NO: 2402 - DNA, 20 bp, Artificial sequence
  Synthetic oligonucleotide
taaatttatcagacaaatta

SEQ ID NO: 2403 - DNA, 20 bp, Artificial sequence
  Synthetic oligonucleotide
tttaaatttatcagacaaat

SEQ ID NO: 2404 - DNA, 20 bp, Artificial sequence
  Synthetic oligonucleotide
atttaaatttatcagacaaa

SEQ ID NO: 2405 - DNA, 20 bp, Artificial sequence
  Synthetic oligonucleotide
aaaatttaaatttatcagac

SEQ ID NO: 2406 - DNA, 20 bp, Artificial sequence
  Synthetic oligonucleotide
ataaaatttaaatttatcag

SEQ ID NO: 2407 - DNA, 20 bp, Artificial sequence
  Synthetic oligonucleotide
agacataaaatttaaattta

SEQ ID NO: 2408 - DNA, 20 bp, Artificial sequence
  Synthetic oligonucleotide
ctagacataaaatttaaatt

SEQ ID NO: 2409 - DNA, 20 bp, Artificial sequence
  Synthetic oligonucleotide
tactttaaaatatggaagtg

SEQ ID NO: 2410 - DNA, 20 bp, Artificial sequence
  Synthetic oligonucleotide
agattactttaaaatatgga

SEQ ID NO: 2411 - DNA, 20 bp, Artificial sequence
  Synthetic oligonucleotide
tctgatacagattactttaa

SEQ ID NO: 2412 - DNA, 20 bp, Artificial sequence
  Synthetic oligonucleotide
agtctgatacagattacttt

SEQ ID NO: 2413 - DNA, 20 bp, Artificial sequence
  Synthetic oligonucleotide
gtattaaaagaatgcaagag

SEQ ID NO: 2414 - DNA, 20 bp, Artificial sequence
  Synthetic oligonucleotide
cactggtattaaaagaatgc

SEQ ID NO: 2415 - DNA, 20 bp, Artificial sequence
  Synthetic oligonucleotide
taaggaaaatacattgtttc

SEQ ID NO: 2416 - DNA, 20 bp, Artificial sequence
  Synthetic oligonucleotide
tgagaaaaactattcataag

SEQ ID NO: 2417 - DNA, 20 bp, Artificial sequence
  Synthetic oligonucleotide
atgagaaaaactattcataa

SEQ ID NO: 2418 - DNA, 20 bp, Artificial sequence
  Synthetic oligonucleotide
accatgagaaaaactattca

SEQ ID NO: 2419 - DNA, 20 bp, Artificial sequence
  Synthetic oligonucleotide
taaatacaccatgagaaaaa

SEQ ID NO: 2420 - DNA, 20 bp, Artificial sequence
  Synthetic oligonucleotide
ataaatacaccatgagaaaa

SEQ ID NO: 2421 - DNA, 20 bp, Artificial sequence
  Synthetic oligonucleotide
gaataaatacaccatgagaa

SEQ ID NO: 2422 - DNA, 20 bp, Artificial sequence
  Synthetic oligonucleotide
aagaataaatacaccatgag

SEQ ID NO: 2423 - DNA, 20 bp, Artificial sequence
  Synthetic oligonucleotide
aaagaataaatacaccatga

SEQ ID NO: 2424 - DNA, 20 bp, Artificial sequence
  Synthetic oligonucleotide
aaaagaataaatacaccatg

SEQ ID NO: 2425 - DNA, 20 bp, Artificial sequence
  Synthetic oligonucleotide
acttaaaagaataaatacac

SEQ ID NO: 2426 - DNA, 20 bp, Artificial sequence
  Synthetic oligonucleotide
gtgaagtatatttaaaaaac

SEQ ID NO: 2427 - DNA, 20 bp, Artificial sequence
  Synthetic oligonucleotide
tgaaacattcaaaagtgaag

SEQ ID NO: 2428 - DNA, 20 bp, Artificial sequence
  Synthetic oligonucleotide
gctgtctgaaacattcaaaa

SEQ ID NO: 2429 - DNA, 20 bp, Artificial sequence
  Synthetic oligonucleotide
actctgtcctgataggtccc

SEQ ID NO: 2430 - DNA, 20 bp, Artificial sequence
  Synthetic oligonucleotide
gaactctgtcctgataggtc

SEQ ID NO: 2431 - DNA, 20 bp, Artificial sequence
  Synthetic oligonucleotide
ccaagtgctcctgaactggt

SEQ ID NO: 2432 - DNA, 20 bp, Artificial sequence
  Synthetic oligonucleotide
tagatcactcccaagtgctc

SEQ ID NO: 2433 - DNA, 20 bp, Artificial sequence
  Synthetic oligonucleotide
acctagatcactcccaagtg

SEQ ID NO: 2434 - DNA, 20 bp, Artificial sequence
  Synthetic oligonucleotide
cacctagatcactcccaagt

SEQ ID NO: 2435 - DNA, 20 bp, Artificial sequence
  Synthetic oligonucleotide
atcacctagatcactcccaa

SEQ ID NO: 2436 - DNA, 20 bp, Artificial sequence
  Synthetic oligonucleotide
catcacctagatcactccca

SEQ ID NO: 2437 - DNA, 20 bp, Artificial sequence
  Synthetic oligonucleotide
agcatcacctagatcactcc

SEQ ID NO: 2438 - DNA, 20 bp, Artificial sequence
  Synthetic oligonucleotide
tagcatcacctagatcactc

SEQ ID NO: 2439 - DNA, 20 bp, Artificial sequence
  Synthetic oligonucleotide
catagcatcacctagatcac

SEQ ID NO: 2440 - DNA, 20 bp, Artificial sequence
  Synthetic oligonucleotide
cacagctgcctgaagcatgt

SEQ ID NO: 2441 - DNA, 20 bp, Artificial sequence
  Synthetic oligonucleotide
tcacagctgcctgaagcatg

SEQ ID NO: 2442 - DNA, 20 bp, Artificial sequence
  Synthetic oligonucleotide
gtcacagctgcctgaagcat

SEQ ID NO: 2443 - DNA, 20 bp, Artificial sequence
  Synthetic oligonucleotide
ggtcacagctgcctgaagca

SEQ ID NO: 2444 - DNA, 20 bp, Artificial sequence
  Synthetic oligonucleotide
tggtcacagctgcctgaagc

SEQ ID NO: 2445 - DNA, 20 bp, Artificial sequence
  Synthetic oligonucleotide
atggtcacagctgcctgaag

SEQ ID NO: 2446 - DNA, 20 bp, Artificial sequence
  Synthetic oligonucleotide
acatggtcacagctgcctga

SEQ ID NO: 2447 - DNA, 20 bp, Artificial sequence
  Synthetic oligonucleotide
agacatggtcacagctgcct

SEQ ID NO: 2448 - DNA, 20 bp, Artificial sequence
  Synthetic oligonucleotide
aagacatggtcacagctgcc

SEQ ID NO: 2449 - DNA, 20 bp, Artificial sequence
  Synthetic oligonucleotide
aaagacatggtcacagctgc

SEQ ID NO: 2450 - DNA, 20 bp, Artificial sequence
  Synthetic oligonucleotide
taaagacatggtcacagctg

SEQ ID NO: 2451 - DNA, 20 bp, Artificial sequence
  Synthetic oligonucleotide
ctaaagacatggtcacagct

SEQ ID NO: 2452 - DNA, 20 bp, Artificial sequence
  Synthetic oligonucleotide
tttctaaagacatggtcaca

SEQ ID NO: 2453 - DNA, 20 bp, Artificial sequence
  Synthetic oligonucleotide
gtttctaaagacatggtcac

SEQ ID NO: 2454 - DNA, 20 bp, Artificial sequence
  Synthetic oligonucleotide
acagtttctaaagacatggt

SEQ ID NO: 2455 - DNA, 20 bp, Artificial sequence
  Synthetic oligonucleotide
gacagtttctaaagacatgg

SEQ ID NO: 2456 - DNA, 20 bp, Artificial sequence
  Synthetic oligonucleotide
tgacagtttctaaagacatg

SEQ ID NO: 2457 - DNA, 20 bp, Artificial sequence
  Synthetic oligonucleotide
ctgacagtttctaaagacat

SEQ ID NO: 2458 - DNA, 20 bp, Artificial sequence
  Synthetic oligonucleotide
tctgacagtttctaaagaca

SEQ ID NO: 2459 - DNA, 20 bp, Artificial sequence
  Synthetic oligonucleotide
tcatttctgacagtttctaa

SEQ ID NO: 2460 - DNA, 20 bp, Artificial sequence
  Synthetic oligonucleotide
aaatcatttctgacagtttc

SEQ ID NO: 2461 - DNA, 20 bp, Artificial sequence
  Synthetic oligonucleotide
caaatcatttctgacagttt

SEQ ID NO: 2462 - DNA, 20 bp, Artificial sequence
  Synthetic oligonucleotide
tttcaaatcatttctgacag

SEQ ID NO: 2463 - DNA, 20 bp, Artificial sequence
  Synthetic oligonucleotide
ttttcaaatcatttctgaca

SEQ ID NO: 2464 - DNA, 20 bp, Artificial sequence
  Synthetic oligonucleotide
ccttacctagatcactccca

SEQ ID NO: 2465 - DNA, 20 bp, Artificial sequence
  Synthetic oligonucleotide
aaagcaaaaatcacatggag

SEQ ID NO: 2466 - DNA, 20 bp, Artificial sequence
  Synthetic oligonucleotide
gggaatgaagaataatgtaa

SEQ ID NO: 2467 - DNA, 20 bp, Artificial sequence
  Synthetic oligonucleotide
tcttaatatgattaaagagg

SEQ ID NO: 2468 - DNA, 20 bp, Artificial sequence
  Synthetic oligonucleotide
ttcttaatatgattaaagag

SEQ ID NO: 2469 - DNA, 20 bp, Artificial sequence
  Synthetic oligonucleotide
agattacaaatttacttaag

SEQ ID NO: 2470 - DNA, 20 bp, Artificial sequence
  Synthetic oligonucleotide
tagattacaaatttacttaa

SEQ ID NO: 2471 - DNA, 20 bp, Artificial sequence
  Synthetic oligonucleotide
agtagattacaaatttactt

SEQ ID NO: 2472 - DNA, 20 bp, Artificial sequence
  Synthetic oligonucleotide
aatttagtagattacaaatt

SEQ ID NO: 2473 - DNA, 20 bp, Artificial sequence
  Synthetic oligonucleotide
tccagggaaatttagtagat

SEQ ID NO: 2474 - DNA, 20 bp, Artificial sequence
  Synthetic oligonucleotide
tccttaatccagggaaattt

SEQ ID NO: 2475 - DNA, 20 bp, Artificial sequence
  Synthetic oligonucleotide
aactgctccttaatccaggg

SEQ ID NO: 2476 - DNA, 20 bp, Artificial sequence
  Synthetic oligonucleotide
gtaactgctccttaatccag

SEQ ID NO: 2477 - DNA, 20 bp, Artificial sequence
  Synthetic oligonucleotide
ttctagcaatcctctcctgc

SEQ ID NO: 2478 - DNA, 20 bp, Artificial sequence
  Synthetic oligonucleotide
ttaaattattatgttaaagt

SEQ ID NO: 2479 - DNA, 20 bp, Artificial sequence
  Synthetic oligonucleotide
tttaaattattatgttaaag

SEQ ID NO: 2480 - DNA, 20 bp, Artificial sequence
  Synthetic oligonucleotide
gtttaaattattatgttaaa

SEQ ID NO: 2481 - DNA, 20 bp, Artificial sequence
  Synthetic oligonucleotide
agtttaaattattatgttaa

SEQ ID NO: 2482 - DNA, 20 bp, Artificial sequence
  Synthetic oligonucleotide
aagtttaaattattatgtta

SEQ ID NO: 2483 - DNA, 20 bp, Artificial sequence
  Synthetic oligonucleotide
gaagtttaaattattatgtt

SEQ ID NO: 2484 - DNA, 20 bp, Artificial sequence
  Synthetic oligonucleotide
tgtgaagtttaaattattat

SEQ ID NO: 2485 - DNA, 20 bp, Artificial sequence
  Synthetic oligonucleotide
gactgtacaaattactgtga

SEQ ID NO: 2486 - DNA, 20 bp, Artificial sequence
  Synthetic oligonucleotide
gagactgtacaaattactgt

SEQ ID NO: 2487 - DNA, 20 bp, Artificial sequence
  Synthetic oligonucleotide
tactaatattcatgatttct

SEQ ID NO: 2488 - DNA, 20 bp, Artificial sequence
  Synthetic oligonucleotide
ctactaatattcatgatttc

SEQ ID NO: 2489 - DNA, 20 bp, Artificial sequence
  Synthetic oligonucleotide
ttcacctactaatattcatg

SEQ ID NO: 2490 - DNA, 20 bp, Artificial sequence
  Synthetic oligonucleotide
tttcacctactaatattcat

SEQ ID NO: 2491 - DNA, 20 bp, Artificial sequence
  Synthetic oligonucleotide
tttttcacctactaatattc

SEQ ID NO: 2492 - DNA, 20 bp, Artificial sequence
  Synthetic oligonucleotide
atttttcacctactaatatt

SEQ ID NO: 2493 - DNA, 20 bp, Artificial sequence
  Synthetic oligonucleotide
ctcaagtatttttcattttc

SEQ ID NO: 2494 - DNA, 20 bp, Artificial sequence
  Synthetic oligonucleotide
gattatactcaagtattttt

SEQ ID NO: 2495 - DNA, 20 bp, Artificial sequence
  Synthetic oligonucleotide
tagattatactcaagtattt

SEQ ID NO: 2496 - DNA, 20 bp, Artificial sequence
  Synthetic oligonucleotide
ttagattatactcaagtatt

SEQ ID NO: 2497 - DNA, 20 bp, Artificial sequence
  Synthetic oligonucleotide
tttagattatactcaagtat

SEQ ID NO: 2498 - DNA, 20 bp, Artificial sequence
  Synthetic oligonucleotide
ttatttagattatactcaag

SEQ ID NO: 2499 - DNA, 20 bp, Artificial sequence
  Synthetic oligonucleotide
tgttatttagattatactca

SEQ ID NO: 2500 - DNA, 20 bp, Artificial sequence
  Synthetic oligonucleotide
cccattgttatttagattat

SEQ ID NO: 2501 - DNA, 20 bp, Artificial sequence
  Synthetic oligonucleotide
agacatatttaaaccgagac

SEQ ID NO: 2502 - DNA, 20 bp, Artificial sequence
  Synthetic oligonucleotide
aagacatatttaaaccgaga

SEQ ID NO: 2503 - DNA, 20 bp, Artificial sequence
  Synthetic oligonucleotide
taagacatatttaaaccgag

SEQ ID NO: 2504 - DNA, 20 bp, Artificial sequence
  Synthetic oligonucleotide
ttaagacatatttaaaccga

SEQ ID NO: 2505 - DNA, 20 bp, Artificial sequence
  Synthetic oligonucleotide
ctaattggccaaagtttaag

SEQ ID NO: 2506 - DNA, 20 bp, Artificial sequence
  Synthetic oligonucleotide
aacttctactactaattggc

SEQ ID NO: 2507 - DNA, 20 bp, Artificial sequence
  Synthetic oligonucleotide
tctctcaacttctactacta

SEQ ID NO: 2508 - DNA, 20 bp, Artificial sequence
  Synthetic oligonucleotide
ttctctcaacttctactact

SEQ ID NO: 2509 - DNA, 20 bp, Artificial sequence
  Synthetic oligonucleotide
agttactttttctctcaact

SEQ ID NO: 2510 - DNA, 20 bp, Artificial sequence
  Synthetic oligonucleotide
tgcttataatttctttgtca

SEQ ID NO: 2511 - DNA, 20 bp, Artificial sequence
  Synthetic oligonucleotide
ctgcttataatttctttgtc

SEQ ID NO: 2512 - DNA, 20 bp, Artificial sequence
  Synthetic oligonucleotide
tctgcttataatttctttgt

SEQ ID NO: 2513 - DNA, 20 bp, Artificial sequence
  Synthetic oligonucleotide
ccttcacctttttattgagt

SEQ ID NO: 2514 - DNA, 20 bp, Artificial sequence
  Synthetic oligonucleotide
tttcaaatccttcacctttt

SEQ ID NO: 2515 - DNA, 20 bp, Artificial sequence
  Synthetic oligonucleotide
cttttcaaatccttcacctt

SEQ ID NO: 2516 - DNA, 20 bp, Artificial sequence
  Synthetic oligonucleotide
atatcttttcaaatccttca

SEQ ID NO: 2517 - DNA, 20 bp, Artificial sequence
  Synthetic oligonucleotide
ttcattaaagccatacctac

SEQ ID NO: 2518 - DNA, 20 bp, Artificial sequence
  Synthetic oligonucleotide
tacacttttacattcccatt

SEQ ID NO: 2519 - DNA, 20 bp, Artificial sequence
  Synthetic oligonucleotide
ttatcaaaaaaatgccaaac

SEQ ID NO: 2520 - DNA, 20 bp, Artificial sequence
  Synthetic oligonucleotide
tttatcaaaaaaatgccaaa

SEQ ID NO: 2521 - DNA, 20 bp, Artificial sequence
  Synthetic oligonucleotide
atttatcaaaaaaatgccaa

SEQ ID NO: 2522 - DNA, 20 bp, Artificial sequence
  Synthetic oligonucleotide
acatttatcaaaaaaatgcc

SEQ ID NO: 2523 - DNA, 20 bp, Artificial sequence
  Synthetic oligonucleotide
tacatttatcaaaaaaatgc

SEQ ID NO: 2524 - DNA, 20 bp, Artificial sequence
  Synthetic oligonucleotide
aagtatacatttatcaaaaa

SEQ ID NO: 2525 - DNA, 20 bp, Artificial sequence
  Synthetic oligonucleotide
tatgtgaacctaagttttct

SEQ ID NO: 2526 - DNA, 20 bp, Artificial sequence
  Synthetic oligonucleotide
gatataagtttttatgtgaa

SEQ ID NO: 2527 - DNA, 20 bp, Artificial sequence
  Synthetic oligonucleotide
aaggtctacatttaggcagt

SEQ ID NO: 2528 - DNA, 20 bp, Artificial sequence
  Synthetic oligonucleotide
ttgtgcattcattaactaaa

SEQ ID NO: 2529 - DNA, 20 bp, Artificial sequence
  Synthetic oligonucleotide
aggaatagaaaaaagtacca

SEQ ID NO: 2530 - DNA, 20 bp, Artificial sequence
  Synthetic oligonucleotide
ggctgtacttaaacaggagg

SEQ ID NO: 2531 - DNA, 20 bp, Artificial sequence
  Synthetic oligonucleotide
ttttatacaaatgttgaggt

SEQ ID NO: 2532 - DNA, 20 bp, Artificial sequence
  Synthetic oligonucleotide
tgttttatacaaatgttgag

SEQ ID NO: 2533 - DNA, 20 bp, Artificial sequence
  Synthetic oligonucleotide
ctcatgttttatacaaatgt

SEQ ID NO: 2534 - DNA, 20 bp, Artificial sequence
  Synthetic oligonucleotide
aagaaaatccagtccactcc

SEQ ID NO: 2535 - DNA, 20 bp, Artificial sequence
  Synthetic oligonucleotide
aaaagaaaatccagtccact

SEQ ID NO: 2536 - DNA, 20 bp, Artificial sequence
  Synthetic oligonucleotide
tctaaaggtttttatcttgc

SEQ ID NO: 2537 - DNA, 20 bp, Artificial sequence
  Synthetic oligonucleotide
cttattatctaaaggttttt

SEQ ID NO: 2538 - DNA, 20 bp, Artificial sequence
  Synthetic oligonucleotide
agaagtgtaccttatgactt

SEQ ID NO: 2539 - DNA, 20 bp, Artificial sequence
  Synthetic oligonucleotide
agtgttatcacctcctggag

SEQ ID NO: 2540 - DNA, 20 bp, Artificial sequence
  Synthetic oligonucleotide
ggagtgttatcacctcctgg

SEQ ID NO: 2541 - DNA, 20 bp, Artificial sequence
  Synthetic oligonucleotide
cagagagatgcctatgtatt

SEQ ID NO: 2542 - DNA, 20 bp, Artificial sequence
  Synthetic oligonucleotide
ggagtgaaagtccaggtttc

SEQ ID NO: 2543 - DNA, 20 bp, Artificial sequence
  Synthetic oligonucleotide
catcttccaatttagcaagc

SEQ ID NO: 2544 - DNA, 20 bp, Artificial sequence
  Synthetic oligonucleotide
gaatcttatttacatcttcc

SEQ ID NO: 2545 - DNA, 20 bp, Artificial sequence
  Synthetic oligonucleotide
tgaatcttatttacatcttc

SEQ ID NO: 2546 - DNA, 20 bp, Artificial sequence
  Synthetic oligonucleotide
gtgaatcttatttacatctt

SEQ ID NO: 2547 - DNA, 20 bp, Artificial sequence
  Synthetic oligonucleotide
atgtgaatcttatttacatc

SEQ ID NO: 2548 - DNA, 20 bp, Artificial sequence
  Synthetic oligonucleotide
attttcaattaaatcctgaa

SEQ ID NO: 2549 - DNA, 20 bp, Artificial sequence
  Synthetic oligonucleotide
gtgattttcaattaaatcct

SEQ ID NO: 2550 - DNA, 20 bp, Artificial sequence
  Synthetic oligonucleotide
ctgacacaaatttagatgga

SEQ ID NO: 2551 - DNA, 20 bp, Artificial sequence
  Synthetic oligonucleotide
cagtgttcagaaatctgact

SEQ ID NO: 2552 - DNA, 20 bp, Artificial sequence
  Synthetic oligonucleotide
ccttctggcctttatgatct

SEQ ID NO: 2553 - DNA, 20 bp, Artificial sequence
  Synthetic oligonucleotide
gagaaattcctttagccatt

SEQ ID NO: 2554 - DNA, 20 bp, Artificial sequence
  Synthetic oligonucleotide
agagaaattcctttagccat

SEQ ID NO: 2555 - DNA, 20 bp, Artificial sequence
  Synthetic oligonucleotide
tagagaaattcctttagcca

SEQ ID NO: 2556 - DNA, 20 bp, Artificial sequence
  Synthetic oligonucleotide
ttagagaaattcctttagcc

SEQ ID NO: 2557 - DNA, 20 bp, Artificial sequence
  Synthetic oligonucleotide
ccaaaattacttcttttatc

SEQ ID NO: 2558 - DNA, 20 bp, Artificial sequence
  Synthetic oligonucleotide
ttccaaaattacttctttta

SEQ ID NO: 2559 - DNA, 20 bp, Artificial sequence
  Synthetic oligonucleotide
gttccaaaattacttctttt

SEQ ID NO: 2560 - DNA, 20 bp, Artificial sequence
  Synthetic oligonucleotide
tgttccaaaattacttcttt

SEQ ID NO: 2561 - DNA, 20 bp, Artificial sequence
  Synthetic oligonucleotide
atgttccaaaattacttctt

SEQ ID NO: 2562 - DNA, 20 bp, Artificial sequence
  Synthetic oligonucleotide
ctgatgttccaaaattactt

SEQ ID NO: 2563 - DNA, 20 bp, Artificial sequence
  Synthetic oligonucleotide
ttttactctttttattgttc

SEQ ID NO: 2564 - DNA, 20 bp, Artificial sequence
  Synthetic oligonucleotide
cccatattttactcttttta

SEQ ID NO: 2565 - DNA, 20 bp, Artificial sequence
  Synthetic oligonucleotide
tacccatattttactctttt

SEQ ID NO: 2566 - DNA, 20 bp, Artificial sequence
  Synthetic oligonucleotide
tagaaaattcaaaaggaggg

SEQ ID NO: 2567 - DNA, 20 bp, Artificial sequence
  Synthetic oligonucleotide
catcatacaatttagaaaat

SEQ ID NO: 2568 - DNA, 20 bp, Artificial sequence
  Synthetic oligonucleotide
ttgcttcaaccatcatacaa

SEQ ID NO: 2569 - DNA, 20 bp, Artificial sequence
  Synthetic oligonucleotide
ctataattcttgcttcaacc

SEQ ID NO: 2570 - DNA, 20 bp, Artificial sequence
  Synthetic oligonucleotide
actgaaaaccaaatcagtgc

SEQ ID NO: 2571 - DNA, 20 bp, Artificial sequence
  Synthetic oligonucleotide
atactgaaaaccaaatcagt

SEQ ID NO: 2572 - DNA, 20 bp, Artificial sequence
  Synthetic oligonucleotide
tatatactgaaaaccaaatc

SEQ ID NO: 2573 - DNA, 20 bp, Artificial sequence
  Synthetic oligonucleotide
ccttaaatatttccaatata

SEQ ID NO: 2574 - DNA, 20 bp, Artificial sequence
  Synthetic oligonucleotide
ataatgccttaaatatttcc

SEQ ID NO: 2575 - DNA, 20 bp, Artificial sequence
  Synthetic oligonucleotide
ccctttatatcctttgaccc

SEQ ID NO: 2576 - DNA, 20 bp, Artificial sequence
  Synthetic oligonucleotide
gttacctccctttatatcct

SEQ ID NO: 2577 - DNA, 20 bp, Artificial sequence
  Synthetic oligonucleotide
aaggttacctccctttatat

SEQ ID NO: 2578 - DNA, 20 bp, Artificial sequence
  Synthetic oligonucleotide
gaaaggttacctccctttat

SEQ ID NO: 2579 - DNA, 20 bp, Artificial sequence
  Synthetic oligonucleotide
agaaaggttacctcccttta

SEQ ID NO: 2580 - DNA, 20 bp, Artificial sequence
  Synthetic oligonucleotide
agaaatatagaaaggttacc

SEQ ID NO: 2581 - DNA, 20 bp, Artificial sequence
  Synthetic oligonucleotide
gcatcagtacaaaagaaata

SEQ ID NO: 2582 - DNA, 20 bp, Artificial sequence
  Synthetic oligonucleotide
atagtgaaattattttccaa

SEQ ID NO: 2583 - DNA, 20 bp, Artificial sequence
  Synthetic oligonucleotide
gtttttaaacaaatagtgaa

SEQ ID NO: 2584 - DNA, 20 bp, Artificial sequence
  Synthetic oligonucleotide
ttcagtttttaaacaaatag

SEQ ID NO: 2585 - DNA, 20 bp, Artificial sequence
  Synthetic oligonucleotide
gttcagtttttaaacaaata

SEQ ID NO: 2586 - DNA, 20 bp, Artificial sequence
  Synthetic oligonucleotide
ttcagcaattaaagactttt

SEQ ID NO: 2587 - DNA, 20 bp, Artificial sequence
  Synthetic oligonucleotide
caaatattagccaaagaggc

SEQ ID NO: 2588 - DNA, 20 bp, Artificial sequence
  Synthetic oligonucleotide
ataatgatcttccaggctgg

SEQ ID NO: 2589 - DNA, 20 bp, Artificial sequence
  Synthetic oligonucleotide
ctaaataatgatcttccagg

SEQ ID NO: 2590 - DNA, 20 bp, Artificial sequence
  Synthetic oligonucleotide
aggactaaataatgatcttc

SEQ ID NO: 2591 - DNA, 20 bp, Artificial sequence
  Synthetic oligonucleotide
atataaatttctatttttgg

SEQ ID NO: 2592 - DNA, 20 bp, Artificial sequence
  Synthetic oligonucleotide
aatataaatttctatttttg

SEQ ID NO: 2593 - DNA, 20 bp, Artificial sequence
  Synthetic oligonucleotide
cagtagagtattacatgcta

SEQ ID NO: 2594 - DNA, 20 bp, Artificial sequence
  Synthetic oligonucleotide
ctttttaatcctgacagtag

SEQ ID NO: 2595 - DNA, 20 bp, Artificial sequence
  Synthetic oligonucleotide
ggtttctttttaatcctgac

SEQ ID NO: 2596 - DNA, 20 bp, Artificial sequence
  Synthetic oligonucleotide
tgggtttctttttaatcctg

SEQ ID NO: 2597 - DNA, 20 bp, Artificial sequence
  Synthetic oligonucleotide
cccctgagatccagccacgg

SEQ ID NO: 2598 - DNA, 20 bp, Artificial sequence
  Synthetic oligonucleotide
agctgtcatttttagttgaa

SEQ ID NO: 2599 - DNA, 20 bp, Artificial sequence
  Synthetic oligonucleotide
gttctctatctctatacagc

SEQ ID NO: 2600 - DNA, 20 bp, Artificial sequence
  Synthetic oligonucleotide
agtggaaaccactaatatgt

SEQ ID NO: 2601 - DNA, 20 bp, Artificial sequence
  Synthetic oligonucleotide
acccactttctctaactagt

SEQ ID NO: 2602 - DNA, 20 bp, Artificial sequence
  Synthetic oligonucleotide
ctgctatcgatttatattcc

SEQ ID NO: 2603 - DNA, 20 bp, Artificial sequence
  Synthetic oligonucleotide
gttataataccacaaagatc

SEQ ID NO: 2604 - DNA, 20 bp, Artificial sequence
  Synthetic oligonucleotide
tgttataataccacaaagat

SEQ ID NO: 2605 - DNA, 20 bp, Artificial sequence
  Synthetic oligonucleotide
agtgttataataccacaaag

SEQ ID NO: 2606 - DNA, 20 bp, Artificial sequence
  Synthetic oligonucleotide
aagtgttataataccacaaa

SEQ ID NO: 2607 - DNA, 20 bp, Artificial sequence
  Synthetic oligonucleotide
gaagtgttataataccacaa

SEQ ID NO: 2608 - DNA, 20 bp, Artificial sequence
  Synthetic oligonucleotide
agacatagaagtgttataat

SEQ ID NO: 2609 - DNA, 20 bp, Artificial sequence
  Synthetic oligonucleotide
tacaatcaagacatagaagt

SEQ ID NO: 2610 - DNA, 20 bp, Artificial sequence
  Synthetic oligonucleotide
tacatggcattttatcacac

SEQ ID NO: 2611 - DNA, 20 bp, Artificial sequence
  Synthetic oligonucleotide
ttatatgtagttctacatgg

SEQ ID NO: 2612 - DNA, 20 bp, Artificial sequence
  Synthetic oligonucleotide
caaactaaaacctagatatt

SEQ ID NO: 2613 - DNA, 20 bp, Artificial sequence
  Synthetic oligonucleotide
gatcaaactaaaacctagat

SEQ ID NO: 2614 - DNA, 20 bp, Artificial sequence
  Synthetic oligonucleotide
agatcaaactaaaacctaga

SEQ ID NO: 2615 - DNA, 20 bp, Artificial sequence
  Synthetic oligonucleotide
aaagatcaaactaaaaccta

SEQ ID NO: 2616 - DNA, 20 bp, Artificial sequence
  Synthetic oligonucleotide
actaaagatcaaactaaaac

SEQ ID NO: 2617 - DNA, 20 bp, Artificial sequence
  Synthetic oligonucleotide
taactaaagatcaaactaaa

SEQ ID NO: 2618 - DNA, 20 bp, Artificial sequence
  Synthetic oligonucleotide
gtaactaaagatcaaactaa

SEQ ID NO: 2619 - DNA, 20 bp, Artificial sequence
  Synthetic oligonucleotide
tttgcccaatttcacccaat

SEQ ID NO: 2620 - DNA, 20 bp, Artificial sequence
  Synthetic oligonucleotide
agttgtaaagatatttaaga

SEQ ID NO: 2621 - DNA, 20 bp, Artificial sequence
  Synthetic oligonucleotide
aaacccaactttctattttg

SEQ ID NO: 2622 - DNA, 20 bp, Artificial sequence
  Synthetic oligonucleotide
ttacaaaaacccaactttct

SEQ ID NO: 2623 - DNA, 20 bp, Artificial sequence
  Synthetic oligonucleotide
tttacaaaaacccaactttc

SEQ ID NO: 2624 - DNA, 20 bp, Artificial sequence
  Synthetic oligonucleotide
gtatttacaaaaacccaact

SEQ ID NO: 2625 - DNA, 20 bp, Artificial sequence
  Synthetic oligonucleotide
atgtatttacaaaaacccaa

SEQ ID NO: 2626 - DNA, 20 bp, Artificial sequence
  Synthetic oligonucleotide
aattcatgtatttacaaaaa

SEQ ID NO: 2627 - DNA, 20 bp, Artificial sequence
  Synthetic oligonucleotide
gtgtatatcaacaattcatg

SEQ ID NO: 2628 - DNA, 20 bp, Artificial sequence
  Synthetic oligonucleotide
ttgtgtatatcaacaattca

SEQ ID NO: 2629 - DNA, 20 bp, Artificial sequence
  Synthetic oligonucleotide
gatagccaccagtatattct

SEQ ID NO: 2630 - DNA, 20 bp, Artificial sequence
  Synthetic oligonucleotide
ccagatagccaccagtatat

SEQ ID NO: 2631 - DNA, 20 bp, Artificial sequence
  Synthetic oligonucleotide
tccccatttcctaatcccag

SEQ ID NO: 2632 - DNA, 20 bp, Artificial sequence
  Synthetic oligonucleotide
ccccagaaaattcccccatg

SEQ ID NO: 2633 - DNA, 20 bp, Artificial sequence
  Synthetic oligonucleotide
gatacacaaccattccattg

SEQ ID NO: 2634 - DNA, 20 bp, Artificial sequence
  Synthetic oligonucleotide
atcaagatacacaaccattc

SEQ ID NO: 2635 - DNA, 20 bp, Artificial sequence
  Synthetic oligonucleotide
tttgacaaatacaccatcaa

SEQ ID NO: 2636 - DNA, 20 bp, Artificial sequence
  Synthetic oligonucleotide
gttctatatattttgacaaa

SEQ ID NO: 2637 - DNA, 20 bp, Artificial sequence
  Synthetic oligonucleotide
tagttctatatattttgaca

SEQ ID NO: 2638 - DNA, 20 bp, Artificial sequence
  Synthetic oligonucleotide
ttatagttctatatattttg

SEQ ID NO: 2639 - DNA, 20 bp, Artificial sequence
  Synthetic oligonucleotide
acttttatagttctatatat

SEQ ID NO: 2640 - DNA, 20 bp, Artificial sequence
  Synthetic oligonucleotide
cacgagtttctttttttgat

SEQ ID NO: 2641 - DNA, 20 bp, Artificial sequence
  Synthetic oligonucleotide
aatgtatttctatttgagca

SEQ ID NO: 2642 - DNA, 20 bp, Artificial sequence
  Synthetic oligonucleotide
caaagtcatcaaaaggcaag

SEQ ID NO: 2643 - DNA, 20 bp, Artificial sequence
  Synthetic oligonucleotide
attctcaaagtcatcaaaag

SEQ ID NO: 2644 - DNA, 20 bp, Artificial sequence
  Synthetic oligonucleotide
gaaaattctcaaagtcatca

SEQ ID NO: 2645 - DNA, 20 bp, Artificial sequence
  Synthetic oligonucleotide
ttccagaaaattctcaaagt

SEQ ID NO: 2646 - DNA, 20 bp, Artificial sequence
  Synthetic oligonucleotide
catttctttaaaatttccag

SEQ ID NO: 2647 - DNA, 20 bp, Artificial sequence
  Synthetic oligonucleotide
accacatttctttaaaattt

SEQ ID NO: 2648 - DNA, 20 bp, Artificial sequence
  Synthetic oligonucleotide
aaacaaaaccacatttcttt

SEQ ID NO: 2649 - DNA, 20 bp, Artificial sequence
  Synthetic oligonucleotide
gaaacaaaaccacatttctt

SEQ ID NO: 2650 - DNA, 20 bp, Artificial sequence
  Synthetic oligonucleotide
ggaaacaaaaccacatttct

SEQ ID NO: 2651 - DNA, 20 bp, Artificial sequence
  Synthetic oligonucleotide
gggaaacaaaaccacatttc

SEQ ID NO: 2652 - DNA, 20 bp, Artificial sequence
  Synthetic oligonucleotide
ttgggaaacaaaaccacatt

SEQ ID NO: 2653 - DNA, 20 bp, Artificial sequence
  Synthetic oligonucleotide
gttgggaaacaaaaccacat

SEQ ID NO: 2654 - DNA, 20 bp, Artificial sequence
  Synthetic oligonucleotide
gcattgcttataactttctc

SEQ ID NO: 2655 - DNA, 20 bp, Artificial sequence
  Synthetic oligonucleotide
ggcattgcttataactttct

SEQ ID NO: 2656 - DNA, 20 bp, Artificial sequence
  Synthetic oligonucleotide
taaaccactgaatagagaaa

SEQ ID NO: 2657 - DNA, 20 bp, Artificial sequence
  Synthetic oligonucleotide
agttaaaccactgaatagag

SEQ ID NO: 2658 - DNA, 20 bp, Artificial sequence
  Synthetic oligonucleotide
aagttaaaccactgaataga

SEQ ID NO: 2659 - DNA, 20 bp, Artificial sequence
  Synthetic oligonucleotide
tcaagttaaaccactgaata

SEQ ID NO: 2660 - DNA, 20 bp, Artificial sequence
  Synthetic oligonucleotide
ttcaagttaaaccactgaat

SEQ ID NO: 2661 - DNA, 20 bp, Artificial sequence
  Synthetic oligonucleotide
aattcaagttaaaccactga

SEQ ID NO: 2662 - DNA, 20 bp, Artificial sequence
  Synthetic oligonucleotide
caaagcagttaaatctggcc

SEQ ID NO: 2663 - DNA, 20 bp, Artificial sequence
  Synthetic oligonucleotide
tgggtttatatatttttctt

SEQ ID NO: 2664 - DNA, 20 bp, Artificial sequence
  Synthetic oligonucleotide
tgtgggtttatatatttttc

SEQ ID NO: 2665 - DNA, 20 bp, Artificial sequence
  Synthetic oligonucleotide
taatccaatgaatgcatctc

SEQ ID NO: 2666 - DNA, 20 bp, Artificial sequence
  Synthetic oligonucleotide
aagtcactgttatattagtt

SEQ ID NO: 2667 - DNA, 20 bp, Artificial sequence
  Synthetic oligonucleotide
gcatgtaaagtcactgttat

SEQ ID NO: 2668 - DNA, 20 bp, Artificial sequence
  Synthetic oligonucleotide
aaaaaaaacccatagcatgt

SEQ ID NO: 2669 - DNA, 20 bp, Artificial sequence
  Synthetic oligonucleotide
gaaaaaaaacccatagcatg

SEQ ID NO: 2670 - DNA, 20 bp, Artificial sequence
  Synthetic oligonucleotide
agaaaaaaaacccatagcat

SEQ ID NO: 2671 - DNA, 20 bp, Artificial sequence
  Synthetic oligonucleotide
gaggagaaaaaaaacccata

SEQ ID NO: 2672 - DNA, 20 bp, Artificial sequence
  Synthetic oligonucleotide
atttcttgaagatgagagga

SEQ ID NO: 2673 - DNA, 20 bp, Artificial sequence
  Synthetic oligonucleotide
agcagattcctgacactgtg

SEQ ID NO: 2674 - DNA, 20 bp, Artificial sequence
  Synthetic oligonucleotide
gagcagattcctgacactgt

SEQ ID NO: 2675 - DNA, 20 bp, Artificial sequence
  Synthetic oligonucleotide
aattatacagaaagagcaga

SEQ ID NO: 2676 - DNA, 20 bp, Artificial sequence
  Synthetic oligonucleotide
acaattatacagaaagagca

SEQ ID NO: 2677 - DNA, 20 bp, Artificial sequence
  Synthetic oligonucleotide
taacaattatacagaaagag

SEQ ID NO: 2678 - DNA, 20 bp, Artificial sequence
  Synthetic oligonucleotide
gtaacaattatacagaaaga

SEQ ID NO: 2679 - DNA, 20 bp, Artificial sequence
  Synthetic oligonucleotide
tgtaacaattatacagaaag

SEQ ID NO: 2680 - DNA, 20 bp, Artificial sequence
  Synthetic oligonucleotide
ctgtaacaattatacagaaa

SEQ ID NO: 2681 - DNA, 20 bp, Artificial sequence
  Synthetic oligonucleotide
cctgtaacaattatacagaa

SEQ ID NO: 2682 - DNA, 20 bp, Artificial sequence
  Synthetic oligonucleotide
tcctgtaacaattatacaga

SEQ ID NO: 2683 - DNA, 20 bp, Artificial sequence
  Synthetic oligonucleotide
aggatgagatacaaggtcaa

SEQ ID NO: 2684 - DNA, 20 bp, Artificial sequence
  Synthetic oligonucleotide
acataaagccattatgtcag

SEQ ID NO: 2685 - DNA, 20 bp, Artificial sequence
  Synthetic oligonucleotide
tacataaagccattatgtca

SEQ ID NO: 2686 - DNA, 20 bp, Artificial sequence
  Synthetic oligonucleotide
gtacataaagccattatgtc

SEQ ID NO: 2687 - DNA, 20 bp, Artificial sequence
  Synthetic oligonucleotide
agccatgtacataaagccat

SEQ ID NO: 2688 - DNA, 20 bp, Artificial sequence
  Synthetic oligonucleotide
aaaaaccaccttgtagctag

SEQ ID NO: 2689 - DNA, 20 bp, Artificial sequence
  Synthetic oligonucleotide
aataaaaaccaccttgtagc

SEQ ID NO: 2690 - DNA, 20 bp, Artificial sequence
  Synthetic oligonucleotide
gaataaaaaccaccttgtag

SEQ ID NO: 2691 - DNA, 20 bp, Artificial sequence
  Synthetic oligonucleotide
agaataaaaaccaccttgta

SEQ ID NO: 2692 - DNA, 20 bp, Artificial sequence
  Synthetic oligonucleotide
cagaataaaaaccaccttgt

SEQ ID NO: 2693 - DNA, 20 bp, Artificial sequence
  Synthetic oligonucleotide
cccagaataaaaaccacctt

SEQ ID NO: 2694 - DNA, 20 bp, Artificial sequence
  Synthetic oligonucleotide
acccagaataaaaaccacct

SEQ ID NO: 2695 - DNA, 20 bp, Artificial sequence
  Synthetic oligonucleotide
catggcaacccagaataaaa

SEQ ID NO: 2696 - DNA, 20 bp, Artificial sequence
  Synthetic oligonucleotide
gcatggcaacccagaataaa

SEQ ID NO: 2697 - DNA, 20 bp, Artificial sequence
  Synthetic oligonucleotide
ctggaacacttttaaaaaat

SEQ ID NO: 2698 - DNA, 20 bp, Artificial sequence
  Synthetic oligonucleotide
tttcttactcccctatgccc

SEQ ID NO: 2699 - DNA, 20 bp, Artificial sequence
  Synthetic oligonucleotide
ttccactttcttactcccct

SEQ ID NO: 2700 - DNA, 20 bp, Artificial sequence
  Synthetic oligonucleotide
tttccactttcttactcccc

SEQ ID NO: 2701 - DNA, 20 bp, Artificial sequence
  Synthetic oligonucleotide
atgtgaatatcctgcctcca

SEQ ID NO: 2702 - DNA, 20 bp, Artificial sequence
  Synthetic oligonucleotide
accttattcagccagagttg

SEQ ID NO: 2703 - DNA, 20 bp, Artificial sequence
  Synthetic oligonucleotide
gcaaccttattcagccagag

SEQ ID NO: 2704 - DNA, 20 bp, Artificial sequence
  Synthetic oligonucleotide
gcccatactttccaggtgcc

SEQ ID NO: 2705 - DNA, 20 bp, Artificial sequence
  Synthetic oligonucleotide
gagcccatactttccaggtg

SEQ ID NO: 2706 - DNA, 20 bp, Artificial sequence
  Synthetic oligonucleotide
tactggagcccatactttcc

SEQ ID NO: 2707 - DNA, 20 bp, Artificial sequence
  Synthetic oligonucleotide
ccctttaccacttttgtgca

SEQ ID NO: 2708 - DNA, 20 bp, Artificial sequence
  Synthetic oligonucleotide
catccctttaccacttttgt

SEQ ID NO: 2709 - DNA, 20 bp, Artificial sequence
  Synthetic oligonucleotide
catgacagccaagatgccag

SEQ ID NO: 2710 - DNA, 20 bp, Artificial sequence
  Synthetic oligonucleotide
ttagcatttctcttctgttg

SEQ ID NO: 2711 - DNA, 20 bp, Artificial sequence
  Synthetic oligonucleotide
tgttgctttcctttcctgca

SEQ ID NO: 2712 - DNA, 20 bp, Artificial sequence
  Synthetic oligonucleotide
gatttcagtctacatctaac

SEQ ID NO: 2713 - DNA, 20 bp, Artificial sequence
  Synthetic oligonucleotide
tcctgatttcagtctacatc

SEQ ID NO: 2714 - DNA, 20 bp, Artificial sequence
  Synthetic oligonucleotide
acctcctgatttcagtctac

SEQ ID NO: 2715 - DNA, 20 bp, Artificial sequence
  Synthetic oligonucleotide
agttttaaccacacctcctg

SEQ ID NO: 2716 - DNA, 20 bp, Artificial sequence
  Synthetic oligonucleotide
aaagagttttaaccacacct

SEQ ID NO: 2717 - DNA, 20 bp, Artificial sequence
  Synthetic oligonucleotide
agcctctttcaaagagtttt

SEQ ID NO: 2718 - DNA, 20 bp, Artificial sequence
  Synthetic oligonucleotide
tctgaaattaataatggtgt

SEQ ID NO: 2719 - DNA, 20 bp, Artificial sequence
  Synthetic oligonucleotide
gctctgaaattaataatggt

SEQ ID NO: 2720 - DNA, 20 bp, Artificial sequence
  Synthetic oligonucleotide
gccttgttttcttccaagaa

SEQ ID NO: 2721 - DNA, 20 bp, Artificial sequence
  Synthetic oligonucleotide
acaaaacatcaagaattcta

SEQ ID NO: 2722 - DNA, 20 bp, Artificial sequence
  Synthetic oligonucleotide
caacaaaacatcaagaattc

SEQ ID NO: 2723 - DNA, 20 bp, Artificial sequence
  Synthetic oligonucleotide
tcaacaaaacatcaagaatt

SEQ ID NO: 2724 - DNA, 20 bp, Artificial sequence
  Synthetic oligonucleotide
ttcaacaaaacatcaagaat

SEQ ID NO: 2725 - DNA, 20 bp, Artificial sequence
  Synthetic oligonucleotide
gttttcaacaaaacatcaag

SEQ ID NO: 2726 - DNA, 20 bp, Artificial sequence
  Synthetic oligonucleotide
tgttttcaacaaaacatcaa

SEQ ID NO: 2727 - DNA, 20 bp, Artificial sequence
  Synthetic oligonucleotide
cttctgttttcaacaaaaca

SEQ ID NO: 2728 - DNA, 20 bp, Artificial sequence
  Synthetic oligonucleotide
tgcttctgttttcaacaaaa

SEQ ID NO: 2729 - DNA, 20 bp, Artificial sequence
  Synthetic oligonucleotide
gaatctttctaaaacttacc

SEQ ID NO: 2730 - DNA, 20 bp, Artificial sequence
  Synthetic oligonucleotide
agaatctttctaaaacttac

SEQ ID NO: 2731 - DNA, 20 bp, Artificial sequence
  Synthetic oligonucleotide
tacagaatctttctaaaact

SEQ ID NO: 2732 - DNA, 20 bp, Artificial sequence
  Synthetic oligonucleotide
gtaccaagattatattgcct

SEQ ID NO: 2733 - DNA, 20 bp, Artificial sequence
  Synthetic oligonucleotide
tgtaccaagattatattgcc

SEQ ID NO: 2734 - DNA, 20 bp, Artificial sequence
  Synthetic oligonucleotide
ttgtaccaagattatattgc

SEQ ID NO: 2735 - DNA, 20 bp, Artificial sequence
  Synthetic oligonucleotide
atgttgtaccaagattatat

SEQ ID NO: 2736 - DNA, 20 bp, Artificial sequence
  Synthetic oligonucleotide
aaatgttgtaccaagattat

SEQ ID NO: 2737 - DNA, 20 bp, Artificial sequence
  Synthetic oligonucleotide
aagtcttattcattgcagct

SEQ ID NO: 2738 - DNA, 20 bp, Artificial sequence
  Synthetic oligonucleotide
taagtcttattcattgcagc

SEQ ID NO: 2739 - DNA, 20 bp, Artificial sequence
  Synthetic oligonucleotide
tctgaatttctaagcattag

SEQ ID NO: 2740 - DNA, 20 bp, Artificial sequence
  Synthetic oligonucleotide
ttctgaatttctaagcatta

SEQ ID NO: 2741 - DNA, 20 bp, Artificial sequence
  Synthetic oligonucleotide
tttctgaatttctaagcatt

SEQ ID NO: 2742 - DNA, 20 bp, Artificial sequence
  Synthetic oligonucleotide
gactttaaaatttagtctga

SEQ ID NO: 2743 - DNA, 20 bp, Artificial sequence
  Synthetic oligonucleotide
gtagactttaaaatttagtc

SEQ ID NO: 2744 - DNA, 20 bp, Artificial sequence
  Synthetic oligonucleotide
agtagactttaaaatttagt

SEQ ID NO: 2745 - DNA, 20 bp, Artificial sequence
  Synthetic oligonucleotide
aagtagactttaaaatttag

SEQ ID NO: 2746 - DNA, 20 bp, Artificial sequence
  Synthetic oligonucleotide
tcaaaatgaatttatttatg

SEQ ID NO: 2747 - DNA, 20 bp, Artificial sequence
  Synthetic oligonucleotide
catcaaaatgaatttattta

SEQ ID NO: 2748 - DNA, 20 bp, Artificial sequence
  Synthetic oligonucleotide
gaaaaccatcaaaatgaatt

SEQ ID NO: 2749 - DNA, 20 bp, Artificial sequence
  Synthetic oligonucleotide
tgagaaaaccatcaaaatga

SEQ ID NO: 2750 - DNA, 20 bp, Artificial sequence
  Synthetic oligonucleotide
ctgagaaaaccatcaaaatg

SEQ ID NO: 2751 - DNA, 20 bp, Artificial sequence
  Synthetic oligonucleotide
tctgagaaaaccatcaaaat

SEQ ID NO: 2752 - DNA, 20 bp, Artificial sequence
  Synthetic oligonucleotide
tgttctgagaaaaccatcaa

SEQ ID NO: 2753 - DNA, 20 bp, Artificial sequence
  Synthetic oligonucleotide
tttccattactcaagcagtg

SEQ ID NO: 2754 - DNA, 20 bp, Artificial sequence
  Synthetic oligonucleotide
aaagacatacaagtttgata

SEQ ID NO: 2755 - DNA, 20 bp, Artificial sequence
  Synthetic oligonucleotide
agttaaaagacatacaagtt

SEQ ID NO: 2756 - DNA, 20 bp, Artificial sequence
  Synthetic oligonucleotide
aagttaaaagacatacaagt

SEQ ID NO: 2757 - DNA, 20 bp, Artificial sequence
  Synthetic oligonucleotide
tggtgggtacataaggttca

SEQ ID NO: 2758 - DNA, 20 bp, Artificial sequence
  Synthetic oligonucleotide
aggaactgataattgttgaa

SEQ ID NO: 2759 - DNA, 20 bp, Artificial sequence
  Synthetic oligonucleotide
gtgaaacaagaattgtcagg

SEQ ID NO: 2760 - DNA, 20 bp, Artificial sequence
  Synthetic oligonucleotide
gcttcaaaataatggaagtt

SEQ ID NO: 2761 - DNA, 20 bp, Artificial sequence
  Synthetic oligonucleotide
tgcttcaaaataatggaagt

SEQ ID NO: 2762 - DNA, 20 bp, Artificial sequence
  Synthetic oligonucleotide
gtgcttcaaaataatggaag

SEQ ID NO: 2763 - DNA, 20 bp, Artificial sequence
  Synthetic oligonucleotide
tgtgcttcaaaataatggaa

SEQ ID NO: 2764 - DNA, 20 bp, Artificial sequence
  Synthetic oligonucleotide
atgtgcttcaaaataatgga

SEQ ID NO: 2765 - DNA, 20 bp, Artificial sequence
  Synthetic oligonucleotide
cttaataaataatgtgataa

SEQ ID NO: 2766 - DNA, 20 bp, Artificial sequence
  Synthetic oligonucleotide
aacttaataaataatgtgat

SEQ ID NO: 2767 - DNA, 20 bp, Artificial sequence
  Synthetic oligonucleotide
aaacttaataaataatgtga

SEQ ID NO: 2768 - DNA, 20 bp, Artificial sequence
  Synthetic oligonucleotide
ctatgtcctaaaagtttctc

SEQ ID NO: 2769 - DNA, 20 bp, Artificial sequence
  Synthetic oligonucleotide
gctatgtcctaaaagtttct

SEQ ID NO: 2770 - DNA, 20 bp, Artificial sequence
  Synthetic oligonucleotide
aattaacataaaagctatgt

SEQ ID NO: 2771 - DNA, 20 bp, Artificial sequence
  Synthetic oligonucleotide
gtaattaacataaaagctat

SEQ ID NO: 2772 - DNA, 20 bp, Artificial sequence
  Synthetic oligonucleotide
aagtaattaacataaaagct

SEQ ID NO: 2773 - DNA, 20 bp, Artificial sequence
  Synthetic oligonucleotide
tagtgcagaaattaagtaat

SEQ ID NO: 2774 - DNA, 20 bp, Artificial sequence
  Synthetic oligonucleotide
ggatggctagtgcagaaatt

SEQ ID NO: 2775 - DNA, 20 bp, Artificial sequence
  Synthetic oligonucleotide
ctagtgcagaaaattagaag

SEQ ID NO: 2776 - DNA, 20 bp, Artificial sequence
  Synthetic oligonucleotide
ggatagctagtgcagaaaat

SEQ ID NO: 2777 - DNA, 20 bp, Artificial sequence
  Synthetic oligonucleotide
agaatgagacatgtaagtat

SEQ ID NO: 2778 - DNA, 20 bp, Artificial sequence
  Synthetic oligonucleotide
ggtgaaaaagaatgagacat

SEQ ID NO: 2779 - DNA, 20 bp, Artificial sequence
  Synthetic oligonucleotide
cctgggtgaaaaagaatgag

SEQ ID NO: 2780 - DNA, 20 bp, Artificial sequence
  Synthetic oligonucleotide
cacctgggtgaaaaagaatg

SEQ ID NO: 2781 - DNA, 20 bp, Artificial sequence
  Synthetic oligonucleotide
aacaaaaattatctagatcc

SEQ ID NO: 2782 - DNA, 20 bp, Artificial sequence
  Synthetic oligonucleotide
gttgagtttttatatttgat

SEQ ID NO: 2783 - DNA, 20 bp, Artificial sequence
  Synthetic oligonucleotide
gggttgagtttttatatttg

SEQ ID NO: 2784 - DNA, 20 bp, Artificial sequence
  Synthetic oligonucleotide
aagatactactatagcatag

SEQ ID NO: 2785 - DNA, 20 bp, Artificial sequence
  Synthetic oligonucleotide
gaagatactactatagcata

SEQ ID NO: 2786 - DNA, 20 bp, Artificial sequence
  Synthetic oligonucleotide
ggaagatactactatagcat

SEQ ID NO: 2787 - DNA, 20 bp, Artificial sequence
  Synthetic oligonucleotide
tggaagatactactatagca

SEQ ID NO: 2788 - DNA, 18 bp, Artificial sequence
  Synthetic oligonucleotide
gcatcttttcatactggc

SEQ ID NO: 2789-2791 - skipped (3 entries)

SEQ ID NO: 2792 - DNA, 18 bp, Artificial sequence
  Synthetic oligonucleotide
agccattaatctatactg

SEQ ID NO: 2793 - DNA, 15 bp, Artificial sequence
  Synthetic oligonucleotide
ataggtcccgctgct

SEQ ID NO: 2794 - DNA, 16 bp, Artificial sequence
  Synthetic oligonucleotide
tgataggtcccgctgc

SEQ ID NO: 2795 - DNA, 16 bp, Artificial sequence
  Synthetic oligonucleotide
ctgataggtcccgctg

SEQ ID NO: 2796 - DNA, 15 bp, Artificial sequence
  Synthetic oligonucleotide
ctgataggtcccgct

SEQ ID NO: 2797 - DNA, 14 bp, Artificial sequence
  Synthetic oligonucleotide
ctgataggtcccgc

SEQ ID NO: 2798 - DNA, 24 bp, Artificial sequence
  Primer
tgacacagacatcaggtacaaatc

SEQ ID NO: 2799 - DNA, 17 bp, Artificial sequence
  Primer
tgctgctgttgctgctt

SEQ ID NO: 2800 - DNA, 25 bp, Artificial sequence
  Probe
agcttcggaagagacgagaagccta

SEQ ID NO: 2801 - DNA, 15 bp, Artificial sequence
  Primer
tcgccgcttgctgca

SEQ ID NO: 2802 - DNA, 17 bp, Artificial sequence
  Primer
atcggccgtgatgtcga

SEQ ID NO: 2803 - DNA, 23 bp, Artificial sequence
  Probe
ccatggtcaaccccaccgtgttc

SEQ ID NO: 2804 - DNA, 19 bp, Artificial sequence
  Primer
gaaggtgaaggtcggagtc

SEQ ID NO: 2805 - DNA, 20 bp, Artificial sequence
  Primer
gaagatggtgatgggatttc

SEQ ID NO: 2806 - DNA, 20 bp, Artificial sequence
  Probe
caagcttcccgttctcagcc

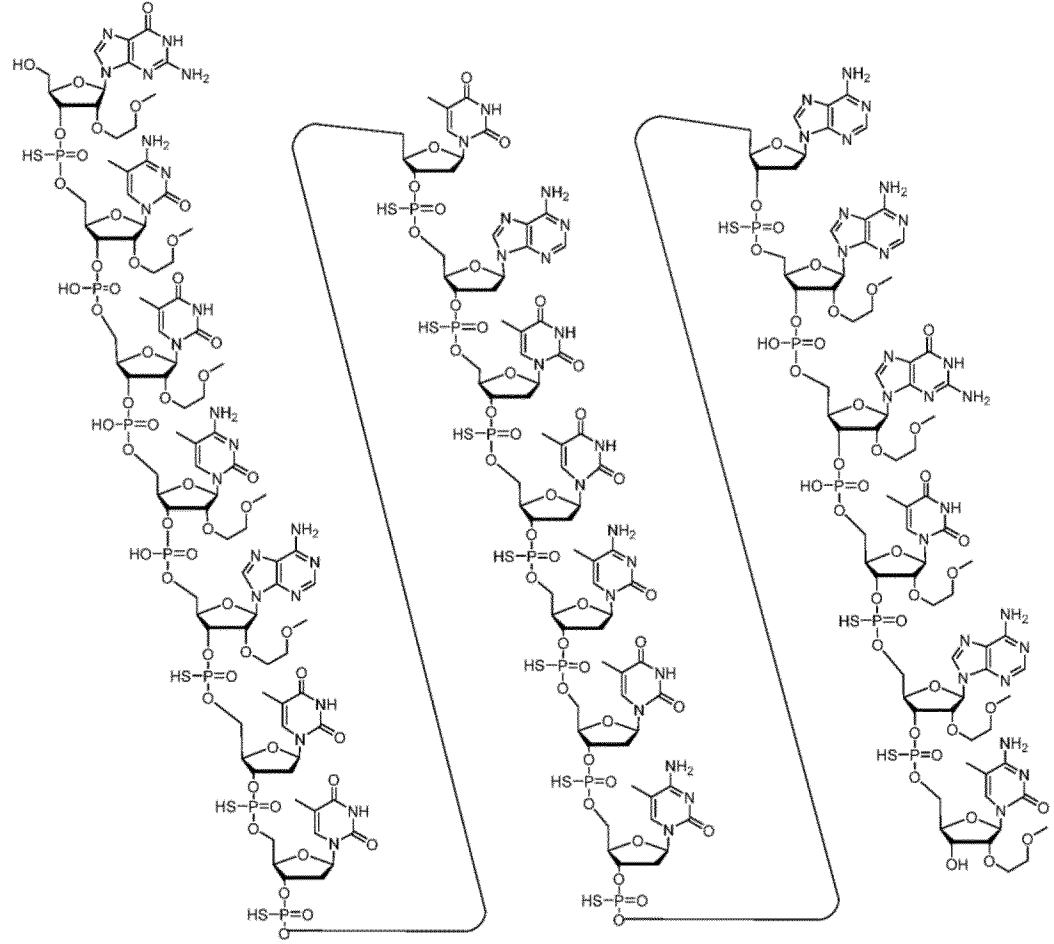

In Claim 3, Columns 255 and 256, the structure should read:
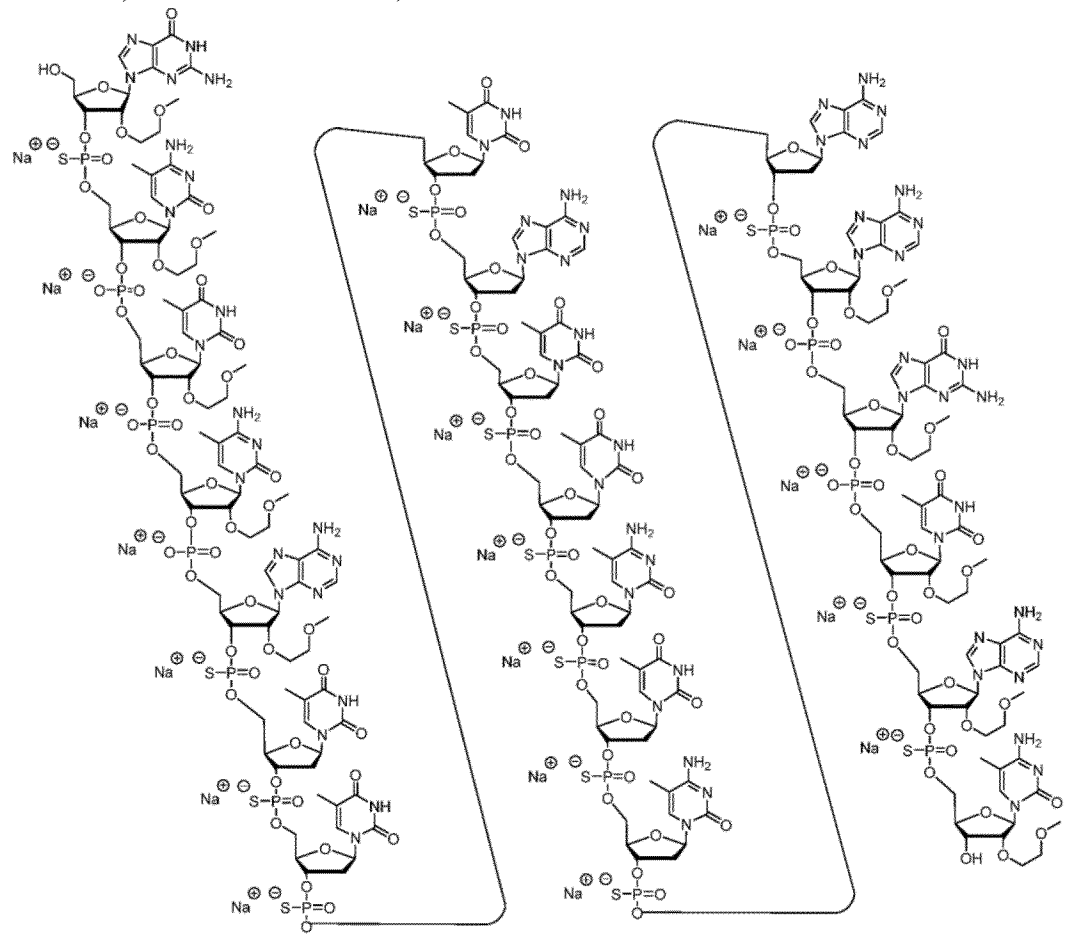

The invention claimed is:
1. A modified oligonucleotide according to the following chemical structure:
(SEQ ID NO: 423)
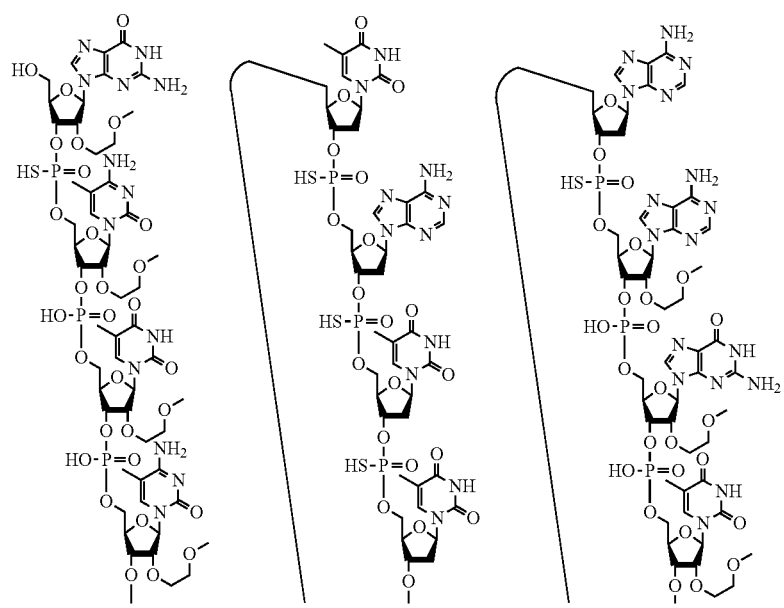
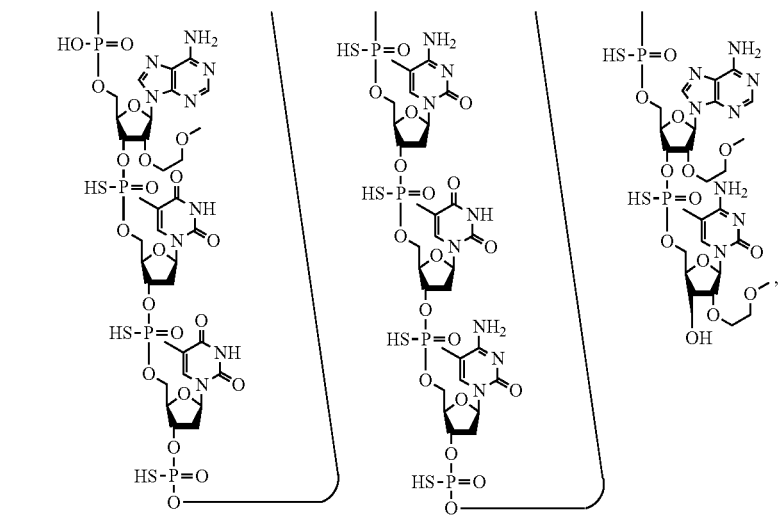
or a salt thereof.

2. The modified oligonucleotide of claim 1, which is the sodium salt or the potassium salt.

3. A modified oligonucleotide according to the following chemical structure:

(SEQ ID NO: 423)

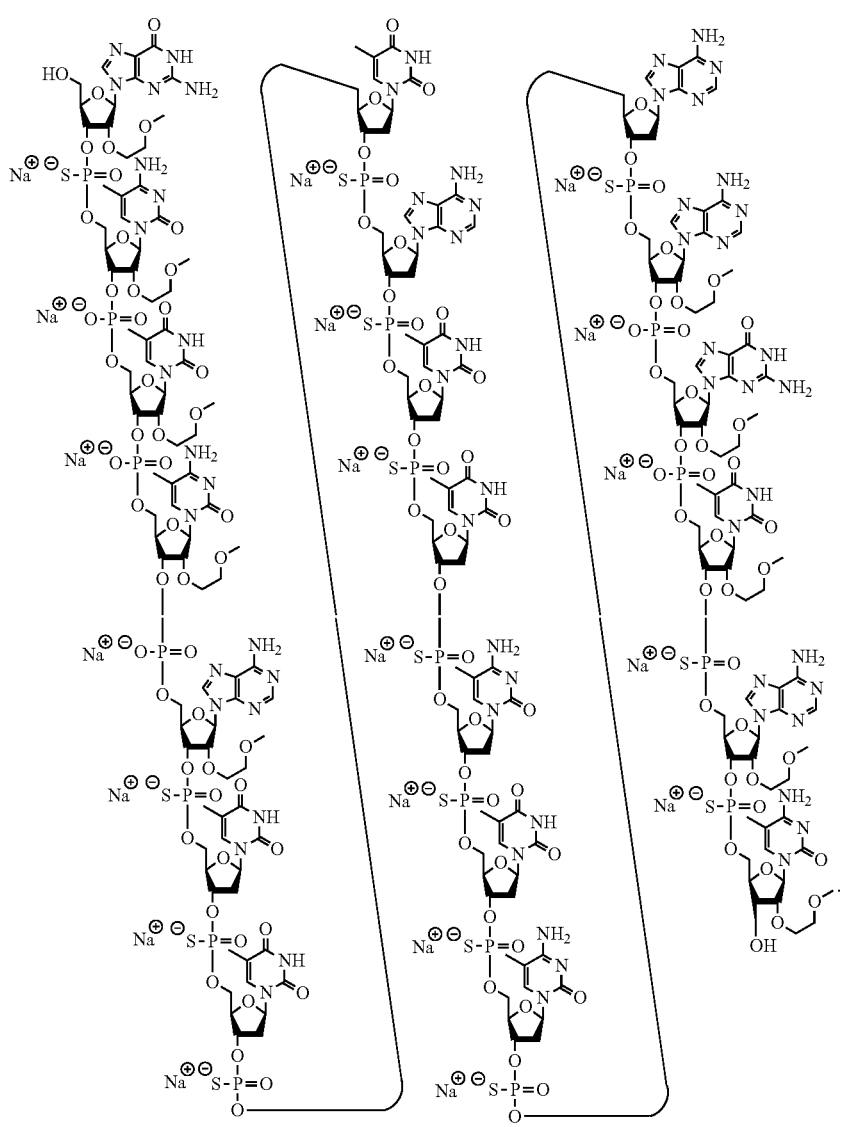

4. An oligomeric compound comprising a modified oligonucleotide according to the following chemical notation:
Ges $^m$Ceo Teo $^m$Ceo Aes Tds Tds Tds Ads Tds Tds $^m$Cds Tds $^m$Cds Ads Aeo Geo Tes Aes $^m$Ce (SEQ ID NO: 423); wherein,
A=an adenine nucleobase,
$^m$C=a 5-methylcytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

5. A population of modified oligonucleotides of claim 1, wherein all of the phosphorothioate internucleoside linkages of the modified oligonucleotide are stereorandom.

6. A pharmaceutical composition comprising the modified oligonucleotide of claim 1 and a pharmaceutically acceptable diluent.

7. The pharmaceutical composition of claim 6, wherein the pharmaceutically acceptable diluent is phosphate-buffered saline (PBS) or artificial cerebrospinal fluid.

8. The pharmaceutical composition of claim 7, wherein the pharmaceutical composition consists essentially of the modified oligonucleotide and artificial cerebrospinal fluid.

9. The pharmaceutical composition of claim 7, wherein the pharmaceutical composition consists essentially of the modified oligonucleotide and PBS.

10. A population of modified oligonucleotides of claim 3, wherein all of the phosphorothioate internucleoside linkages of the modified oligonucleotide are stereorandom.

11. A pharmaceutical composition comprising the modified oligonucleotide of claim 3 and a pharmaceutically acceptable diluent.

12. The pharmaceutical composition of claim 11, wherein the pharmaceutically acceptable diluent is phosphate-buffered saline (PBS) or artificial cerebrospinal fluid.

13. The pharmaceutical composition of claim 12, wherein the pharmaceutical composition consists essentially of the modified oligonucleotide and artificial cerebrospinal fluid.

14. The pharmaceutical composition of claim 12, wherein the pharmaceutical composition consists essentially of the modified oligonucleotide and PBS.

15. A population of oligomeric compounds of claim 4, wherein all of the phosphorothioate internucleoside linkages of the modified oligonucleotide are stereorandom.

16. A pharmaceutical composition comprising the oligomeric compound of claim 4 and a pharmaceutically acceptable diluent.

17. The pharmaceutical composition of claim 16, wherein the pharmaceutically acceptable diluent is phosphate-buffered saline (PBS) or artificial cerebrospinal fluid.

18. The pharmaceutical composition of claim 17, wherein the pharmaceutical composition consists essentially of the oligomeric compound and artificial cerebrospinal fluid.

19. The pharmaceutical composition of claim 17, wherein the pharmaceutical composition consists essentially of the oligomeric compound and PBS.

20. A method comprising administering to a subject a pharmaceutical composition of claim 6.

21. A method of treating a disease associated with ATXN3, comprising administering to a subject having or at risk for developing a disease associated with ATXN3 a therapeutically effective amount of a pharmaceutical composition according to claim 6 and thereby treating the disease associated with ATXN3.

22. The method of claim 21, wherein the disease associated with ATXN3 is a neurodegenerative disease.

23. The method of claim 22, wherein the neurodegenerative disease is SCA3.

24. The method of claim 22, wherein at least one symptom or hallmark of the neurodegenerative disease is ameliorated.

25. The method of claim 24, wherein the symptom or hallmark is any of ataxia, neuropathy, and aggregate formation.

26. The method of claim 21, wherein the subject is human.

27. A method of reducing expression of ATXN3 in a cell comprising contacting the cell with a modified oligonucleotide of claim 1.

28. The method of claim 27, wherein the cell is a human cell.

29. The method of claim 20, wherein the subject has or is at risk for developing a disease associated with ATXN3.

30. A pharmaceutical composition comprising the population of modified oligonucleotides of claim 5 and a pharmaceutically acceptable diluent.

31. The pharmaceutical composition of claim 30, wherein the pharmaceutically acceptable diluent is phosphate-buffered saline (PBS) or artificial cerebrospinal fluid.

32. The pharmaceutical composition of claim 31, wherein the pharmaceutical composition consists essentially of the population of modified oligonucleotides and artificial cerebrospinal fluid.

33. The pharmaceutical composition of claim 31, wherein the pharmaceutical composition consists essentially of the population of modified oligonucleotides and PBS.

34. A pharmaceutical composition comprising the population of modified oligonucleotides of claim 10 and a pharmaceutically acceptable diluent.

35. The pharmaceutical composition of claim 34, wherein the pharmaceutically acceptable diluent is phosphate-buffered saline (PBS) or artificial cerebrospinal fluid.

36. The pharmaceutical composition of claim 35, wherein the pharmaceutical composition consists essentially of the population of modified oligonucleotides and artificial cerebrospinal fluid.

37. The pharmaceutical composition of claim 35, wherein the pharmaceutical composition consists essentially of the population of modified oligonucleotides and PBS.

38. A pharmaceutical composition comprising the population of oligomeric compounds of claim 15 and a pharmaceutically acceptable diluent.

39. The pharmaceutical composition of claim 38, wherein the pharmaceutically acceptable diluent is phosphate-buffered saline (PBS) or artificial cerebrospinal fluid.

40. The pharmaceutical composition of claim 39, wherein the pharmaceutical composition consists essentially of the population of oligomeric compounds and artificial cerebrospinal fluid.

41. The pharmaceutical composition of claim 39, wherein the pharmaceutical composition consists essentially of the population of oligomeric compounds and PBS.

42. A population of modified oligonucleotides of claim 2, wherein all of the phosphorothioate internucleoside linkages of the modified oligonucleotide are stereorandom.

43. A pharmaceutical composition comprising the modified oligonucleotide of claim 2 and a pharmaceutically acceptable diluent.

44. The pharmaceutical composition of claim 43, wherein the pharmaceutically acceptable diluent is phosphate-buffered saline (PBS) or artficial cerebrospinal fluid.

45. The pharmaceutical composition of claim 44, wherein the pharmaceutical composition consists essentially of the modified oligonucleotide and artificial cerebrospinal fluid.

46. The pharmaceutical composition of claim 44, wherein the pharmaceutical composition consists essentially of the modified oligonucleotide and PBS.

47. A pharmaceutical composition comprising the population of modified oligonucleotides of claim 42 and a pharmaceutically acceptable diluent.

48. The pharmaceutical composition of claim 47, wherein the pharmaceutically acceptable diluent is phosphate-buffered saline (PBS) or artficial cerebrospinal fluid.

49. The pharmaceutical composition of claim 48, wherein the pharmaceutical composition consists essentially of the population of modified oligonucleotides and artificial cerebrospinal fluid.

50. The pharmaceutical composition of claim 48, wherein the pharmaceutical composition consists essentially of the population of modified oligonucleotides and PBS.

* * * * *

UNITED STATES PATENT AND TRADEMARK OFFICE
CERTIFICATE OF CORRECTION

PATENT NO. : 11,434,488 B2  
APPLICATION NO. : 17/053997  
DATED : September 6, 2022  
INVENTOR(S) : Susan M. Freier Page 1 of 14

It is certified that error appears in the above-identified patent and that said Letters Patent is hereby corrected as shown below:

In the Specification

In Columns 11 and 12, the structure should read:

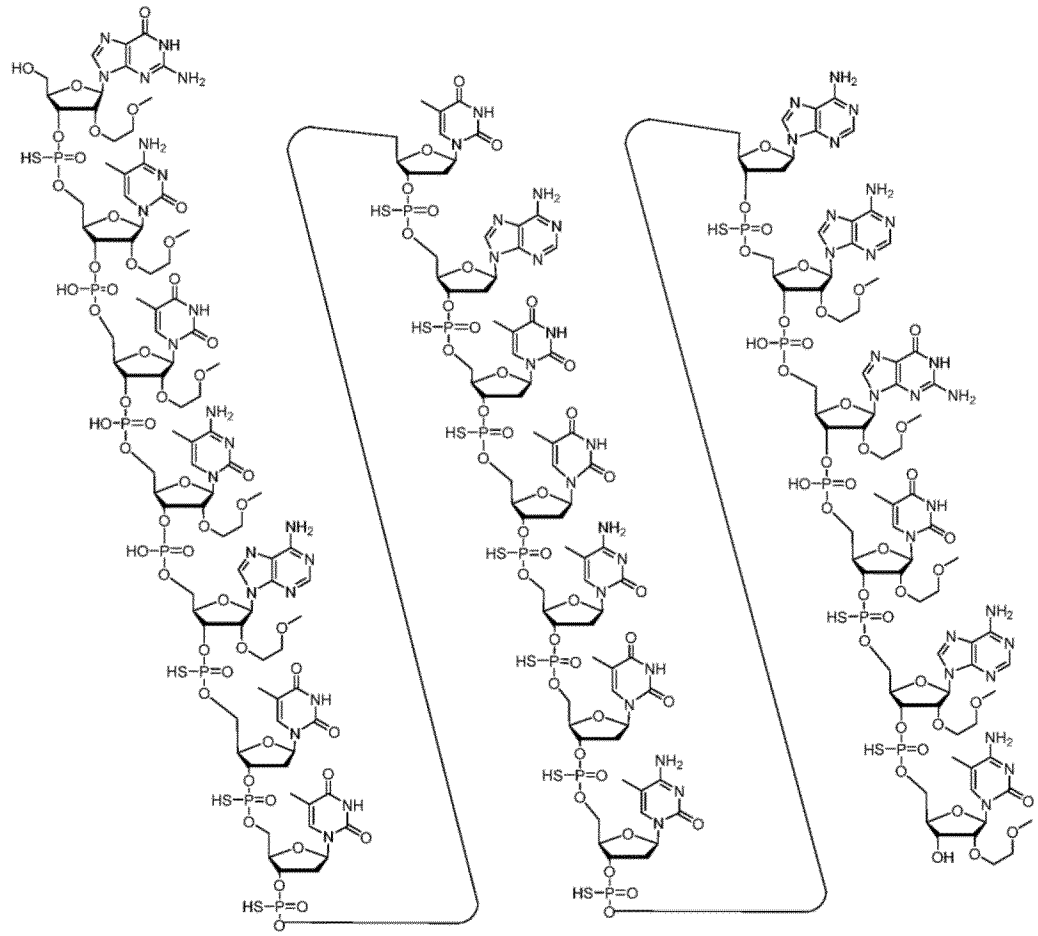

Signed and Sealed this  
Thirteenth Day of December, 2022

Katherine Kelly Vidal  
*Director of the United States Patent and Trademark Office*

CERTIFICATE OF CORRECTION (continued)
U.S. Pat. No. 11,434,488 B2

In Columns 13 and 14, the structure should read:

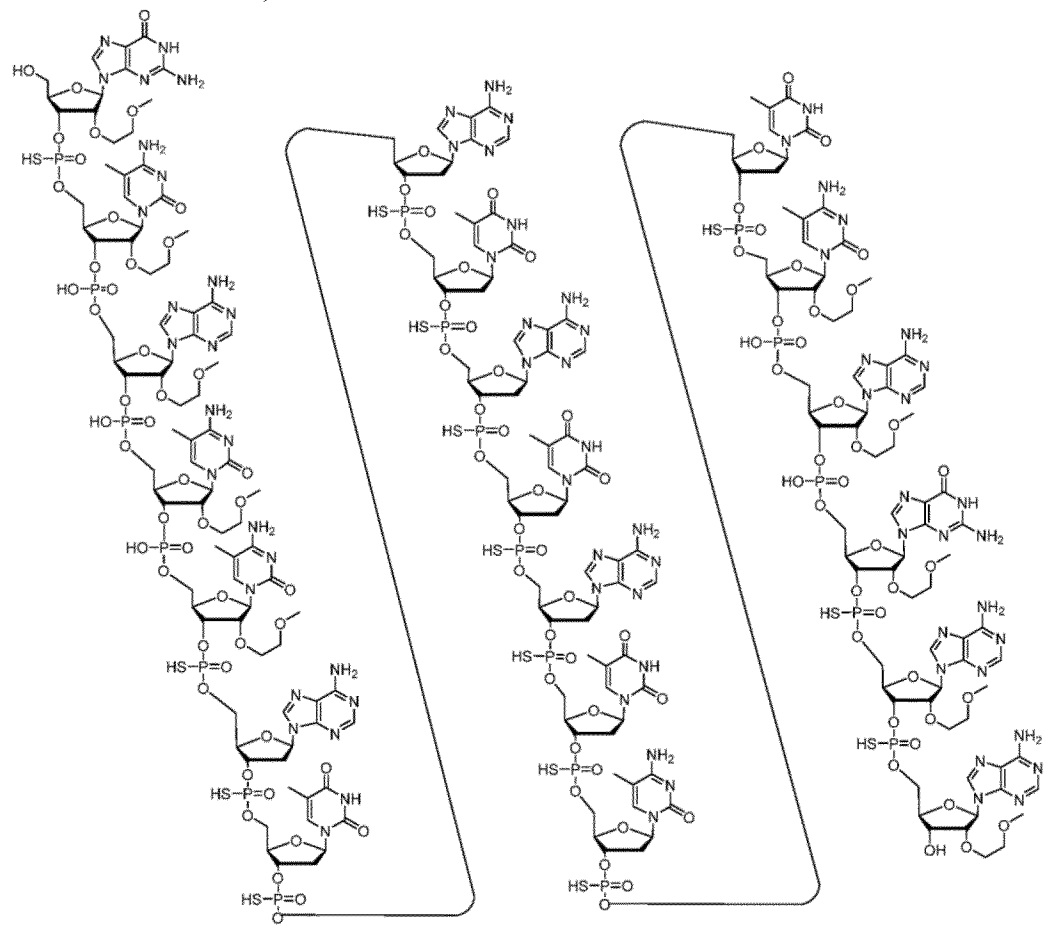

In Columns 15 and 16, the structure should read:
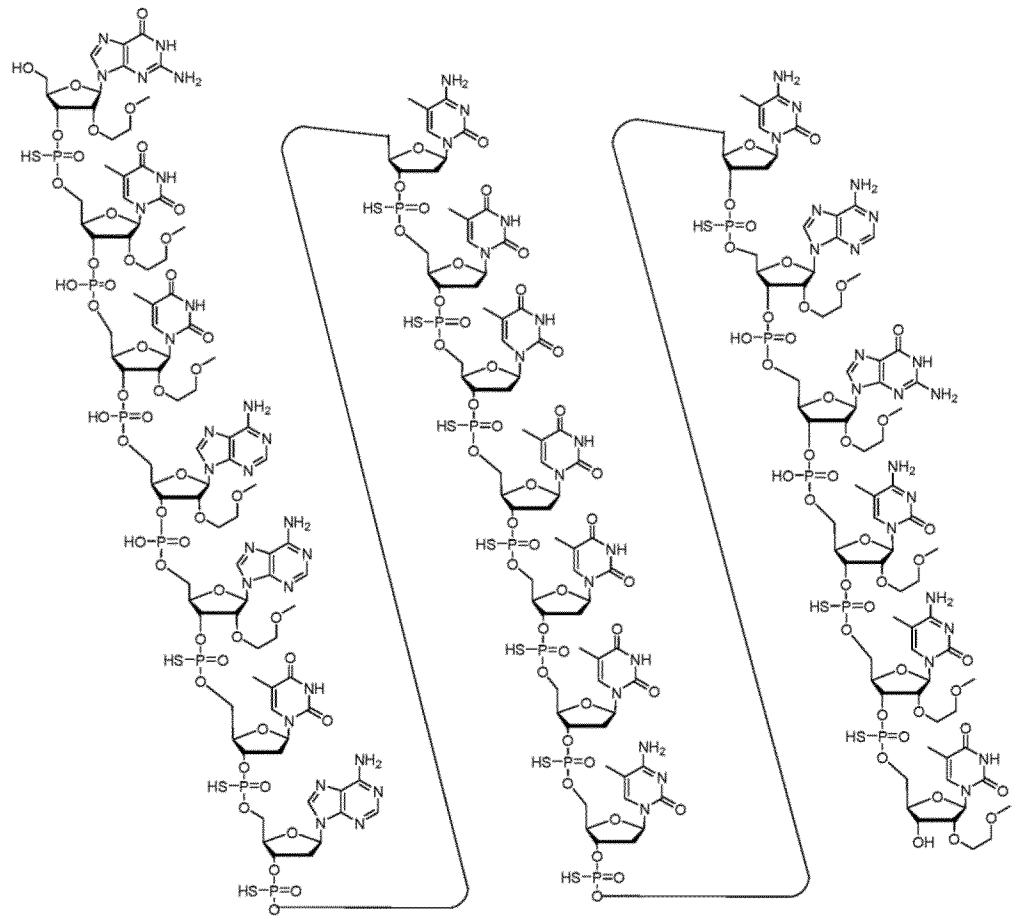

CERTIFICATE OF CORRECTION (continued)
U.S. Pat. No. 11,434,488 B2

In Columns 17 and 18, the structure should read:

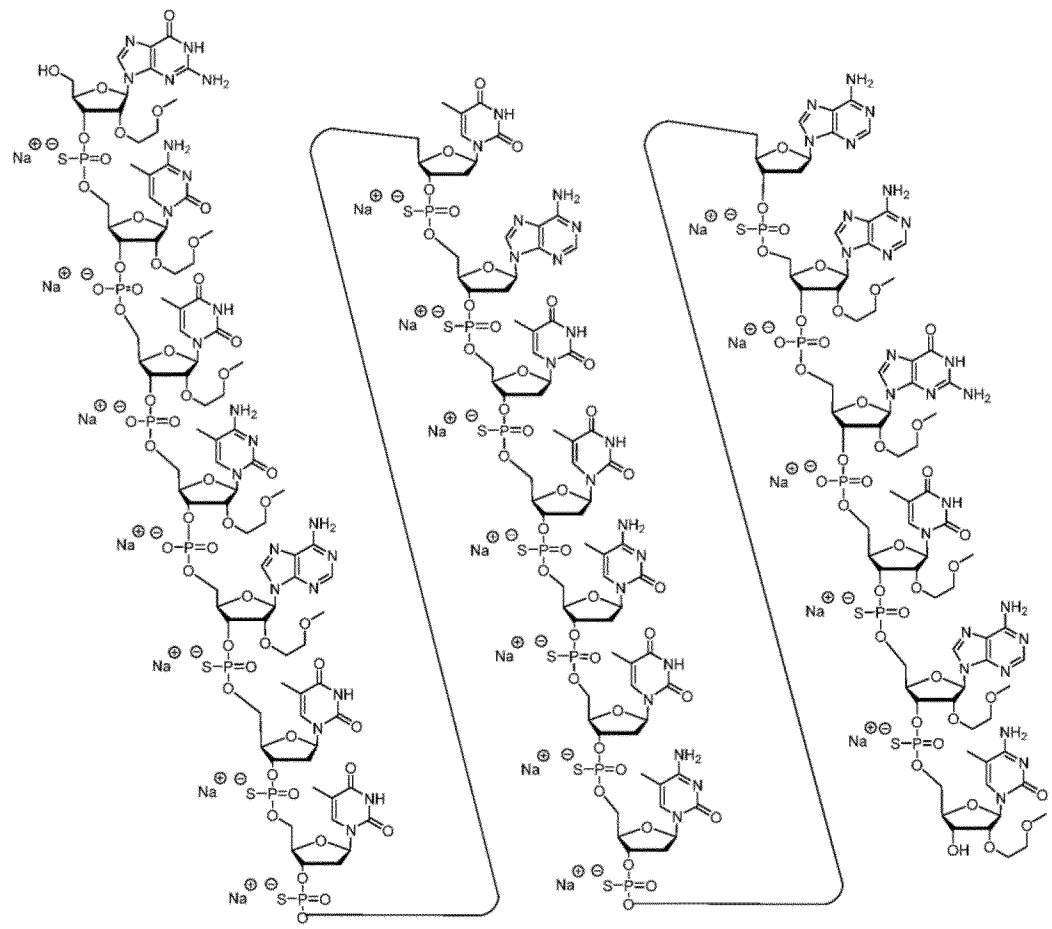

In Columns 19 and 20, the structure should read:
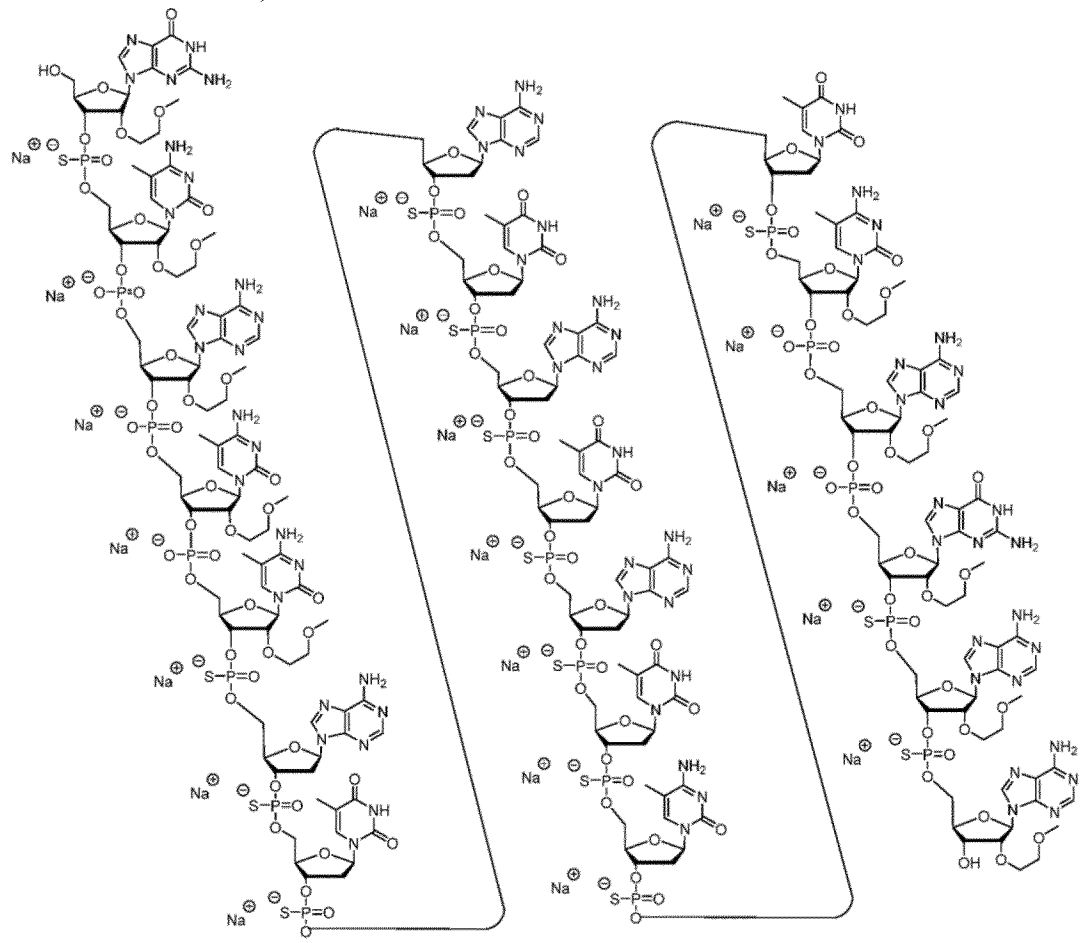

In Columns 21 and 22, the structure should read:
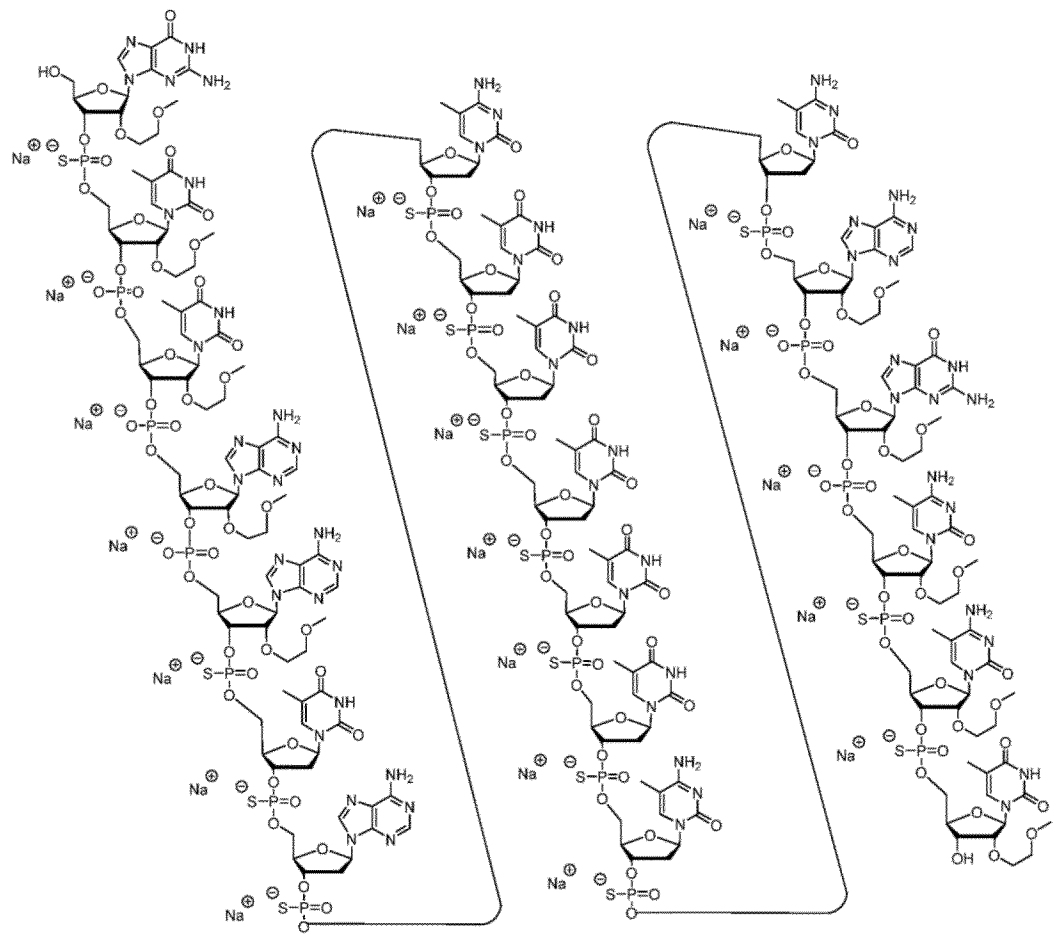

CERTIFICATE OF CORRECTION (continued)
U.S. Pat. No. 11,434,488 B2

In Columns 45 and 46, the structure should read:

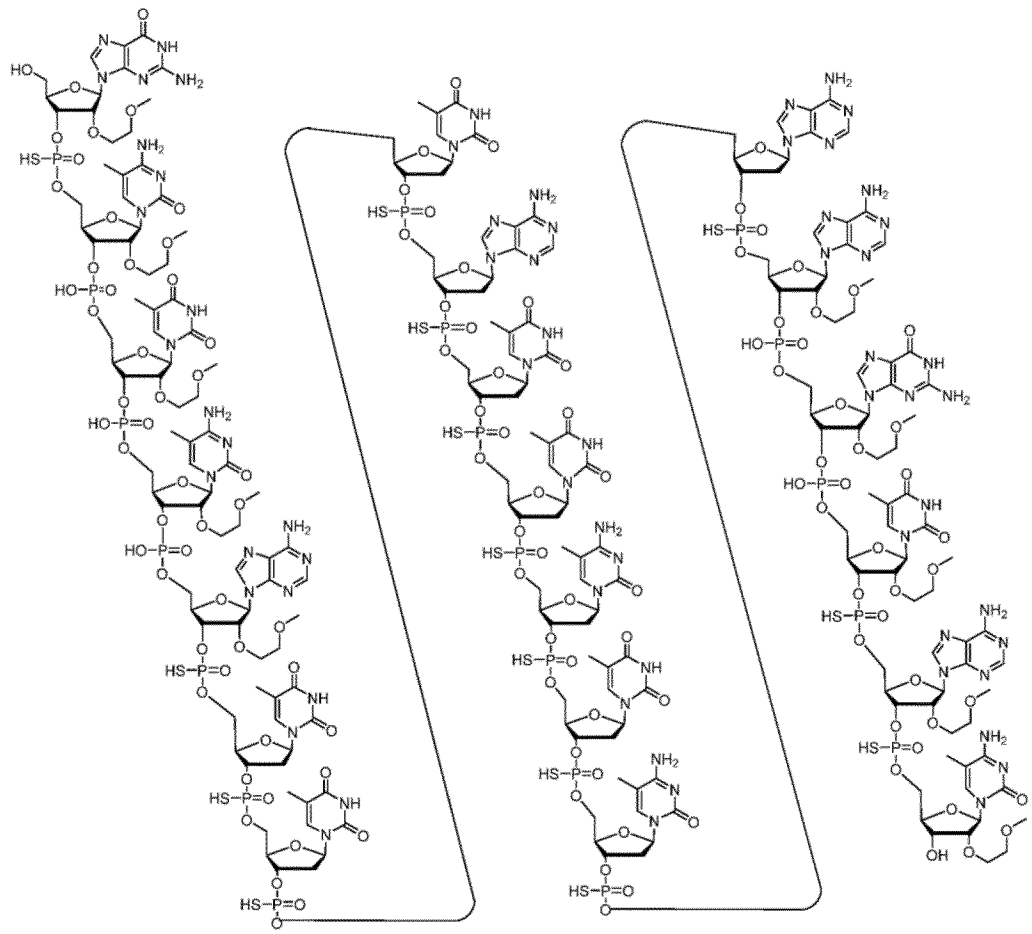

CERTIFICATE OF CORRECTION (continued)
U.S. Pat. No. 11,434,488 B2

In Columns 47 and 48, the structure should read:

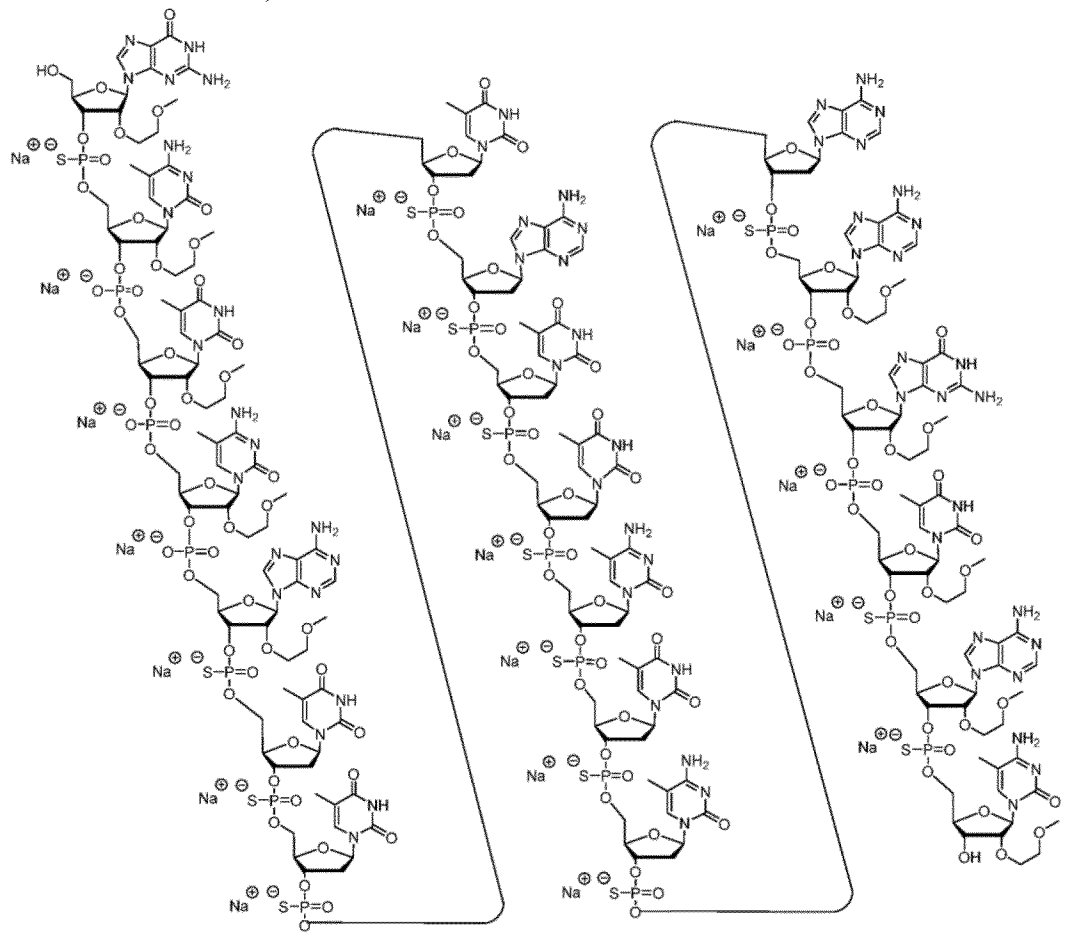

In Columns 49 and 50, the structure should read:
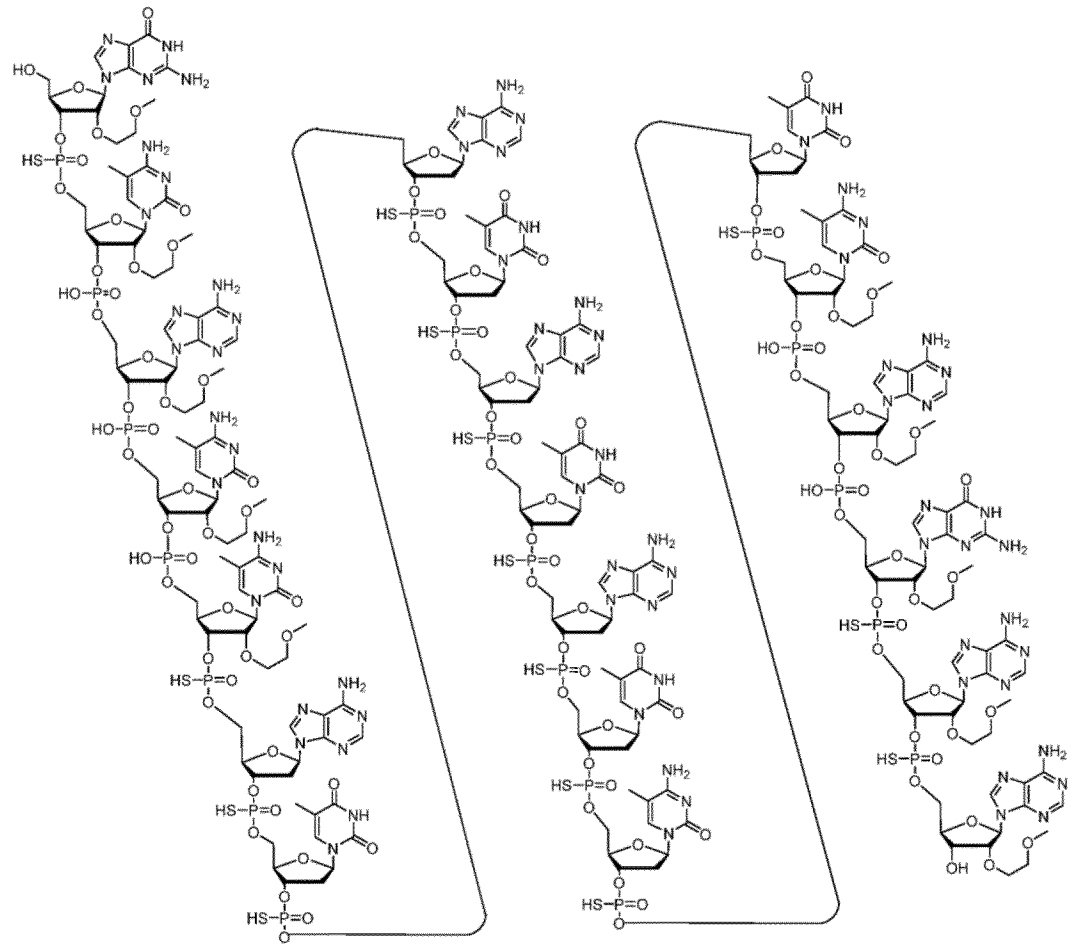

CERTIFICATE OF CORRECTION (continued)

In Columns 51 and 52, the structure should read:

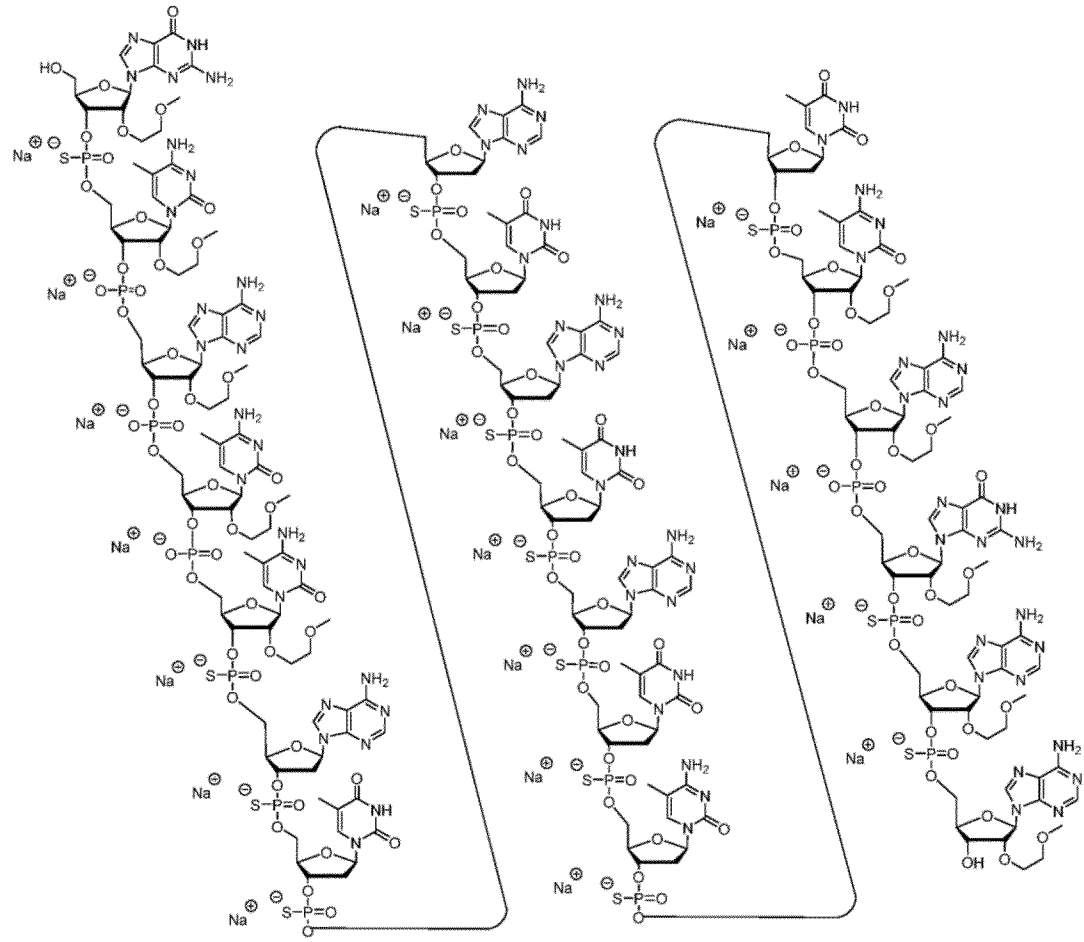

CERTIFICATE OF CORRECTION (continued)
U.S. Pat. No. 11,434,488 B2

In Columns 53 and 54, the structure should read:

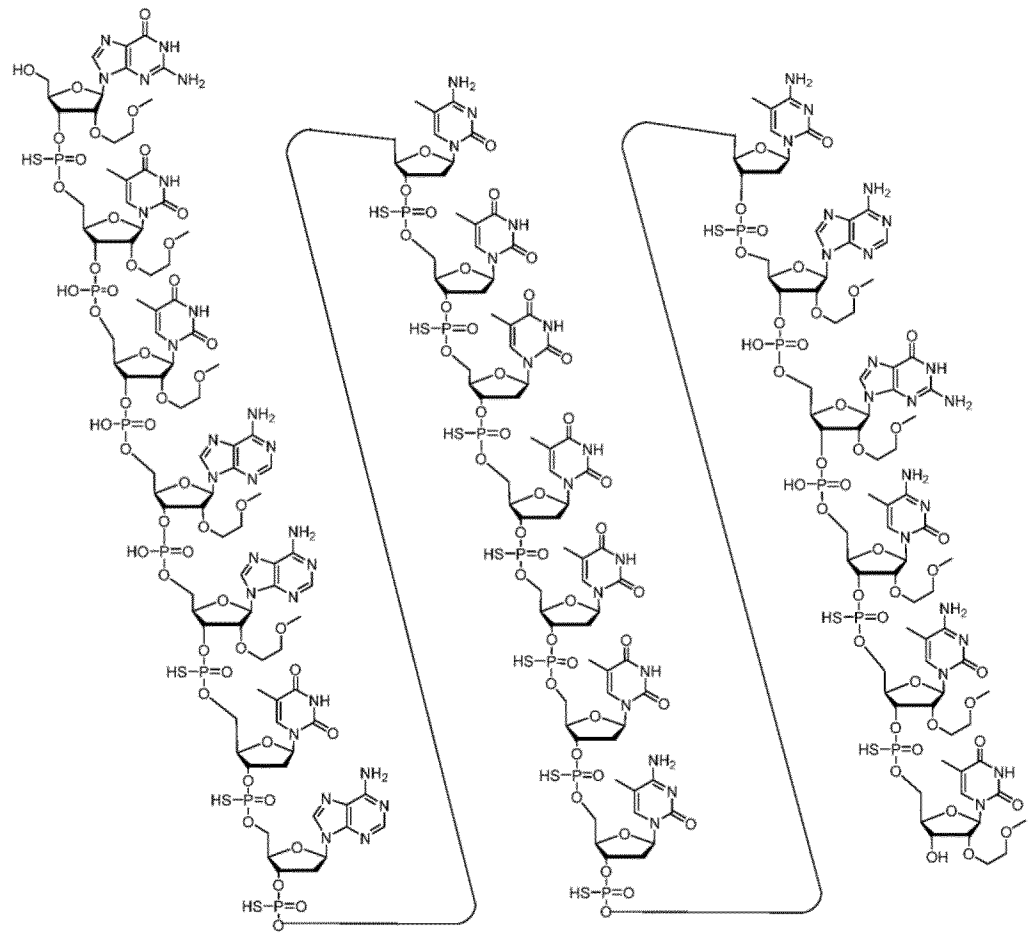

CERTIFICATE OF CORRECTION (continued)
U.S. Pat. No. 11,434,488 B2

In Columns 55 and 56, the structure should read:

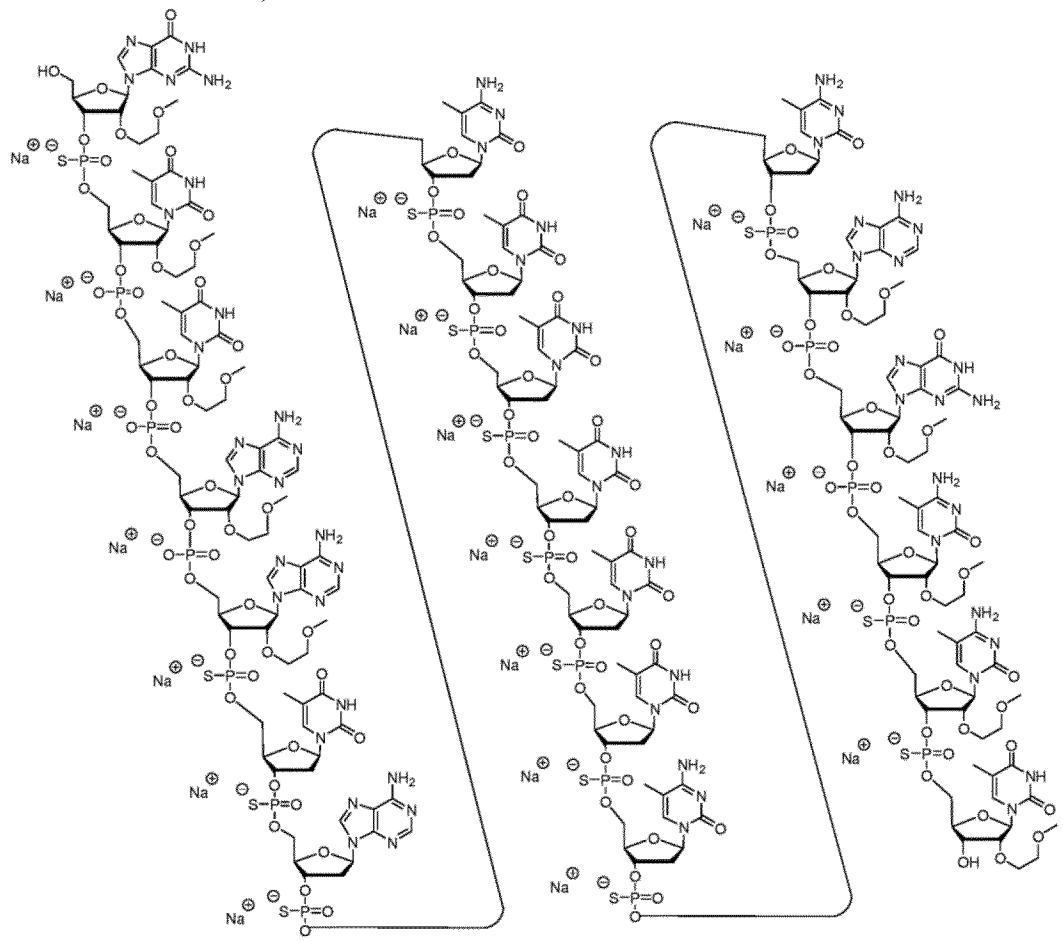

CERTIFICATE OF CORRECTION (continued)
U.S. Pat. No. 11,434,488 B2

In the Claims

In Claim 1, Columns 253 and 254, the structure should read: